United States Patent 12,746,261 (PROBIOTIC BACILLUS COMPOSITIONS AND METHODS OF USE) - sequence listing, part 7

SEQ ID NO: 10 - DNA, 4084681 bp, Bacillus amyloliquefaciens (residues 1-2,042,341 of 4,084,681)
taaaaaaccatacattgaagtgacatacacgattccgaaggcggacacgccgtctgtcaaagcgtatcataacggagattcgacaggactttcaatatcagctggaaaaaagctgaaggcgccaaaagctataaagtgtggctttataacgggaaagaatatcaagccatttctgtcggcaatgcaacctcttggagcacaaaaggaaaaacatctggccgacaaaagcaaaatcgactccggcaaatataagctgcatacagacggaaaaggcggaagtgaattagcgcttaatccttcgccggtctataaaaaactccggcggcagctatccggcaagtaaaaattactgggtcgcggtcagcgcggttgaccagggagaaggcgccatgtctgcggccgccaagcccgtcattccgaatattggagttcagaaaccaagcacgaaaggctttaataacaacaacgccacaggctggtttgatctttcctggaaagccgtatcaggcgcagccgggtataaaatgcaagtctttaacggcaaaaagctttgaaacgcttgacctcggaaataaaacatcctggtccacaaaaaatcaaaacatctggccgacaaaggcggaaatcagcgccggaaaatatgcgcttcacctgaaagacaaaaaagcgcggaattgccgatcaacccgggccccgtttataaaaatgccggcggacgcaaaccggaaaacatacggatttaaagtaatcgcctataacaaagacggagaagcgatcgcctcaccggaagctagtccggcgctgcctgatatcgcaaagccgaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcgggataccgatcattggacgacccaaaacaaacacatctggccgtcagccgatgaagtgaaagcgggaaaattccagcttcacacggacggaaaggcgcgaactggcgcttgacccttcacctgtttacgaaaacgcaaacggcaattacaaagggaagaaaactattcctttacgctgaccgcctatgacgcaaatggtgacagtataccgacggcaccttttaaccctgtttccatgaaggtgcggaattcctcggaacggaagaattctggtctattatcgacattccggacggacagctgaacggcgcgacgggaaatgtcatcgtcaatgaagaagatattcaatcgacggacgcggccggggctcggactctcccggacctttaacagccttgacagctctgaccatatttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcgggcaccgcctggccaaagccgttaatgcgaaaaaagaaacgtatgattacagctatgacgccggcaaaaaaacgctgctcatgacgcagccgaacggccgcaaagtgcagtacgctataacgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacgacttgatgctgtttctgagacggatcaaagcggaaaatcctcatccgccgtgtatgaaatggaaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctaaacccggttcaaaacagcagtttcacggctaaagcagatggctggagcacaagcggagccgcgctgaccttgatgaaggcttcgatgatgacagctcattaaaagcgtcccgcacaaatgcatcacaagccaatgcggccgcaaaacaaaccgtcacattaggccaaagcgcgacgataagccggtatatatcacgctgacagggatgtccaaggcagacggcgtaaaattaacgaacgacaatgattacgcgcttcaggccggcgtcacctatgcggacggcacgacgggcgtctacaccgccaaattcccgcaggggacacaggaatggaaccgggcggcggcagtcattccgaaaacaaagccgatcaataaaatcgaaatcagcattctgtcaaaaaaagcgccacagaacggcgtgtttgatgacatcccgattaatcgaagaagcatcctacgaaaaacacctatgacgaaaaaggaaactacgtcacaaaagaaagacgaactagttatgcaagcactgcttcatatgacgagactggcaagaaaatgtctgaaaccgacgcgaaaggcgaaacaaccgcctacaatacgatcaggccgaccagctgacaaagcaccctgtcaaacggcacatccatccttcacagctatgacaaggaaggaaatgagctgaccaaaaacgattcgggccggcgcaaaccagacctatcatatgaatatacgtcatggcaagctcgtcaaaacaaccgaccgctcggcaatgtactgaagagtgaatatgacgccaacagcaacctgacgaaaaccgtttccgccaacggcaatgaagtgtcgctgacctatgacggcacgaccgggttaagtcaaaagcgtataacggcactgaaaaatacaactttacctatgacaaaaacggcaatgaaacgtcggtcacaaacaaagaacaaaatacaacgaaaaaacgcactttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatattgaaatgaaacggcacttcagcctatacatttgattatgatgaaaacggcaatgtccaacattcatcagcggaaatgaagtcggcacgagcttctcatatgatgagcggaatcttgtcagctctcttcatatcggagcgaaaaacggcggcagcatcttccggaaagctatgaatacgacgccaacggcaaccgcacggtcatcgacagctcagccggcgaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaagtgaatgagaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaatcggatttataaagctgctaaaacatataaactatctagaaaaagtgtacggctagaagggcctactcaagttatagggatataactggaaaaacttctagttcaaaaattattctactaatgtaaaaagaagaactttgaaaaaatttaagaagacaaggatggagaaaatcagttcatcatgggggtgttatcactatgacgaaaaatggaataagtattccctaaggaaacatgctaagtcaagtccctatccaaccgcggaatatacacctaaaggtagaaaaaaattcacacacaaaatcagaatgcgacattaaaggggaaataagatggatcactatttattgatcatcctaaggagttaaaagtctatcaatccataattaattccttatgtcacgtagatcaaacattgcctaaacaagtttttaagcaaaggaaaaattattatttatcgaggaattccattgggtatatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgtgtttgggcttcaccgactttaaagtgggcgatttatggtgaagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaacacttacggcacattacaaataagtatattttaatacctactaccgatatcatctgattgttctaaacgggatttcaaataatctccagatagtatttttgcattcaacagatatttaatgacaaatatgcagagtaatatattttggggcttgtttgaataatctatgtttatcatcaagacacttctatcaatgggtttgttagtgttagttaggagaaggagaagacaatgcacaaacaaattgaacaatagagtagattatattgacgagggatgtaatattttaaaggtcgattatcagttctttaaaaaagacctgttttaaggttcaggttgttaaaaatgcagcatctgttatttagtgcagatattggtgatatgagattagaaaaaatagattcggaagaatacaattggcaagtatttgagatgagttaccacccggaaggaatcggtaatctatcaaatgctgtaattccggagtatcaatcaaatgctaattttctcattgacatgaacagaatgctgattgctgtagaagctgaaacagttcgctttgacgaccaatcattttatgcgtatcatccgaaatcataaataaacaaataagagaggttcccagcctctcttttcttacataacgaaatcgttcgcggaggcaaacatgaacactcctttaaatttacaaaaagaatcattgagggctatagggaatctggatgtgattaatccgcttaaatacaattcgatttattcatgtgatctagtgagtaaagatactttttctcaaattaatgaatgacttagagttcgaaacagctctaatagaagtaatggcattcccttcttttattgaagaatggaagaagaaggttgaaaagaaaatgataaatatgaatactgtatcgaaaaagttcattcatattgaatgtgtcctaaccaaagaagaattgatggcagattacttattagatgaattatattttttagcatcgatcaatgattttgttgttataatagcaaaccctgccaaaaataagtcctgcatgaacctgaacactcaaaaggttgatgtaactactgaaagtaatgaaaaaatcatttggtttgaatacgatgcagcagatttatatatcattgattaatttaatataaatttcaggttcctattcaacggagtgttgctgatgttaaaacttaccgcggagcgtgttgggtcatatgaaagggaaaatatcatttatttcaatgcgggtcgggatgatcaagtatttattgtgtcggtgcacgatcacaaagtaatattggaggttatgaaaggcagctctcttttaatcaaaaaagagttacacggattttctgaagatgcccatttctatctgattgattcgtatgatgacactatcgtgatcgtttacctggagaatcatacgtgtcaattggctgcatactgcgtaaacagtaataaaatcaatccgatttgttcttttctattaagcgccaatgtatttcatctgggtgaggatggattattatggatcggattaacggacgagggtatgtatgatgagagaaatcctcaaggaaaagcgatatttgcttttcatgcagaagacagaacgttttattttgaagacgattttaaagaaatgatgcacgaatgctatgccgtacaatcgatcaaatctgatttgtatgtatgtttcgagggagaggattgctgtgtcatcgggcattatcagattggacggacagaattcgtactgttgcagaatatgtgctggacggcgatcaatactcctattgtgatcagctatccgttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtaaagtattgatcaatcctatgcagatggctttttacagccatctgcatatcattttacggagtgaacgatcgatataaataggataccatccaagactcaaggggcaatgacatgaaaataaaaatgaataagatagtcgaagaatcagtaaaaggatgtttttgtcattttgataactgcgggcgtctgtatctcggacggcatcagaatggcgggctttcgtttacgatcatcgacaaatcgggcgatacgcgagtgattcatatcgatgaacaaatcccgtatgaggatattatgctgttccaacagagttcggctgactggtatgtgttgattttctttgaatcgcatgagtataaagtgaaagtattttcagcagaaggaacagaacaaagtgcattttctctcccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaacccacattgatcagcagctttcagaaatatatgcgcccgcggtagatgactgttatgcacttgcagaaaaagacggactaatctacatgctgtattacgcttatacagtcattgctgcgtttgaagaaaccgacgtgaaacgagtgtggattatttctgataaagcatattccggggtttacgaccagctagcgatttcagataacgggttttgggtatgcaaagatgatcattcactgtctctcattccggccgatgtcagtctgccgatgcaagagataacgtgctgtgatgcggatggcgatgagctttccgggcatcagctgaagctgactggcgatgccatttacgcggtctcgaattcagggatttataagcgggatatcagtaatgggaaagcggctaaatgagatgttaagatccaacagatattctttaaataatgacgtcatcagaagcttgaaattacacaaaaagaattagaggggccgctgccttcagatgcagggagattcgaagaagactttgagggtgctgcctgcgctggggatttttatgaatacttcgcacttgtctgcggcagcttagattttgttttggcgaataaacaaatgcctgcacggcagcgtaaagccttatataaatccttttttgagctgtatccgcaatatgcgcagctgaaaaacgctttgatggattatccggagctcagccaggaaatcgggcggcacgaacgggccaggaggctgttagtcagcattttaaacaagaaatgaaaggcaggattttgacgtgaaagaacccacaagagcagaatgtctgaaaaaggctggtctgatcctgaacggtcaagcggcgagggaagaagtgtcggattgggcgtctgagtatgtgagtgcaggtgatccggcggatgaggacgaaaccgtttgggagatgctcgtatatttgagcgggtttgatctgaaagattcgcctgatgcgtatctgcatacgatagaagaattaagagattgggtgcaggaatataaagaagttcatggggatttgtaagaaaaaaattcatttgagtcagacatgtcaattcagctgaaaaaaaggaggcgcaaaatggaatggcacaaacatgagaaagcagttctgccggggccaggttcgccgggttgttttgaattgacggagtttacgttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccagtcgacggcggctgggaatcgatccgctactatgtcgatgacggggaaggaagtatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgaacggctggcgtatgtggtgattgacgaagcggatgaaatgctgaatatgggatttattgaacaggtggaagccatcattcagcatctgccgaaaaacagagtcaccatgttgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggataaatcatctttgctgcgtgatgtcctgatcaccgaaaacccggacagctgcatcatattctgccggacaaaagaaagggtcatccagttaaccgatgagctggacaggctgggctacccttgtgataaaattcacggcggcatggtgcaggaagaccgctttgacgtcatgaatgaattcaagcgcggcgagttccgctatctcattgcgaccgacgttgccgccagaggaattgatatcgaaaacatcagcctcgtcatcaattatgatattccgcttgaaaaagaaagctatgtgcaccgcacaggcagaacgggccgcgccggacaccgcggacgggccgttacgtttgtgacgccggctgaatcgcggtttctgaatgacattgagacatatatcggtttccgcatccaaaagcgggaggcgccgtccgagaaagaaacagcggaacggaaagcggcttttgcggaaaaattgaacgcccgccccgatgtcaaaacagacaaaagcgaacagttaaacaaagacatcatgaaactgtactttaacggcgggaaaaagaagaaactcagagcggtcgattttgtcgggacgatcgcgaaaatcgacggcgtttcagccgatgatatcgggattatcacgattctggacaacgcaacatacgtcgaaattctgaacggaaaaggcccgcacgttcttgacatcatgaaaaatacgacggtcaaaggcaaaaaactgaaagtccataaagccaagaaataaaatagaaagcctgccgcgtgcaggctttttttacgccgtttcctcaggcacaaacgcaaggatggcaatgccgatcacaaataacaaaatcaggctgaacacggcggctgacgaatttccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaacccagaaatcaaaagcggaatccataaaataagcatacgtgcagacaatcatatacacgccgattccggcataaagcattgtttttcctttaaaccgttcggccagccgctcgtacaaaatcgaaaaaggggcggcgacgacctgtgtgacaaataaaacaatcagcagatttgccgcgctgatgccgaggtcagccccgtatgacgtggacattgtaatgatggtgccgaccccgtcgatatagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcggaatcgaaaacagtccccaccatgccgccgtaattaaaaaggcaatgcggcccgcagtctgggcggacagcggaatcacctccgcttgtgctgacagaatcacggcaatgctcaggagaaaagggattgtactgccgatatagcccagcccaaacccctggcggacaccatattcatccgctcctttgcggccacatcaacgagaaacgcatcataaaacacattagatccggcaaagccgatcgtggaaatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaatgatttctgaacggcgttttctgattgacctggagatattgacctggtacaaaaaggatgtacaatcaaggtgtagcaggtaaatggtcaggcgggagggagacggaattgaagattgcgaaagtcaataataataatgtcgtcagtgtgctcaaagaaggcaatcaggaattggtcatcatgggccggggcattgcttttcaaaagaaaacgggagatccggcagatgaagcccgcattgagaaagtgctcaccctcgataacaaagatgtatccgaagttcaaaacccttttgtatgatattccgatcgagtgtatgaaagtatccgaggagattatcagctatgcgaaattacagcttggcaaaaagctcaacgacagcatctatgtgtcgctgaccgaccatattactttgccattcagcgcaataagaaagggctggatatcaaaacgccttgctgtgggaaacgaagcggctctacaaagacgaatttgcaatcggaaaagaatcgctgatcatggtaaaaaacaagactggcgtgtctctgccggaggatgaagcaggttttattgcgctgcatattgtaaatgccgagctgaatgaggagatgcccaatatcatcagcattacaaaagtcatgcaagagattttgagtatcgtaaaataccattttaagattgaattcaacgaagaatcgcttcactattatcggtttgtcacccacttaaagtttttcgcgcagcgtctttttaacggcacacatcgactttttgctggagaaaaataccgtcgggcgtatgaatgcacgaagaaaatccaaacttgcattgagagggcgtatgagcacaagctcaccagtgacgagctgctgtatttaacgattcacatagaaagggtagtcaaacaagcataatgaaagcgttggcattattgttcttggattcattttttcttacattcacatatgatcttgttaggattgttgctgataagcatgcaaaacctaaattacaatgagcgcggatcatttctgtttgtgctgatggtaatttaggtttttttaagattcgttattatcattattctgaccgatgttcccttttaacagaatcatgtatgatcgataaagaaatcgctctcaaagaaaggggaatgccgacatgttttatcgtatgaaacgagtgctgctcattcttgtcactggattgtttttgagtttgtgtgcgatcacttctgctgcatcagctcaaacaggcggatcgttttttgaaccttttaacagctataactccggtttctggcaaaaagcaaatggttactccaatggagatatgttcaactgcacttggcgtgcaaataatgtatccgtgacgtcatcaggtgaaatgcgtttggcgctgacaagcccgtcttataacaagtttgactgcggggagaaccgctccgctcaaacctatggctatggactttatgaagtcagaatgaaaccggctaaaaacacggggatcgtttcatcgttcttcacttatacaggtccaacggatggtaccccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccgaactctataaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccagcggaaatccttttttaattaaaacgaaataatcccaatcaaaagcgccgcaatcgtcatcacaatcgttgttcccacggcccatttaatagtgaatttttgatggtcgccaaagctgacgcctgccattccgaccaatagataggtggatggcacaagcgggctgagcagatgcaccggctgtcccagcaaggaggctcttccgatttcagcggcgtctattccgtaagcggaagcggcttcggcgatgatgggaagaacaccgaagtaaaaggcgtcattcgacatgaaaaaggtgaaaggcatgctggcaatcgccgtgatcaacggcagatgcggacccatggcatcagggatgagggaaacgagagaatgcgccatcgcatcgaccatttttgtgcctgagagaatgcctgtaaatatgcctgccgcaaacaccattgagacaacgtttaacgcattacccgcatgcgccgaaatccgtttctgctgctctttgacatttggatagttaatcatcaaggcgatggcgaacgcgatcataaaaagaacagggatgggaagcaggctggtgatcagcgcggccatcagagcgacagtcagcagcaggttaaaccactggagagcgggacgcttcagcggcgccgcctccggatcagaagacggcgcgtgttcaatcgaaatgatgccgagacgcttccgttctttttttccaaggagataagcaacggcgatcacccagagaacgccggcgatcatagcgggaatcagcggcgtaaaaacttctgacgtgtccaatttcaaggaagccaaaaccctcgccgtcggtccgccccacggaataatattcatgacgcccgaaccgagcatcgcaatccccgccagcaccaaacggttcatgccgagccgtttgtaaaggggcagcattgccgcaatcgtaatcatatacgttgttgtcccatctccgtccagcgaaatggtcatcgtcagaaccgctgtgcctacggcgatttttaacgggtctcctttgacaaacgataagattttggcaatgagaggatcaaacaggcctgagtcgatcataatgccgaaatacaggatggcgaataacagcataatcccggtaggagcgaggtctgtaacaccctgaatcatcatcccgccgagatctttgccaaatccgctgatcagggcaaacacaacaggaacgacaatcaaagcaataagtgcggaaagccggttagacataataaggtacataaaaacaatcatcatcacaaaaccgagtatggcaagcatgatatgacctcccctgttcaacagctgttttggtaagcgctttcacattttgtttctgtgaaaatggcttatttcaaaatgtgtatgaccgcatatgtaaatacagacctaaaatcctaatgagcggatcagcagtttatttaaagaacgccgcgggtaaatgtgctgtagaatgtttcgttttaaaaggggaactgacatgagtgatgatcaaaacaaacgagtaaatgaacactcaaaggacgaacagctggagcagtaccgatctgataacagcggcaaaaaaatgacgaccaatcaggggcttcgcgtgtctgaggatgagcattccttaaaagcgggcgtccgcggccccacgctgatggaggattttcattttcgtgaaaaaatgacgcactttgaccacgagcggattccggaacgggttgttcatgcacgcgggtacggcgttcatgggcattttcaggtgtacgaaccgatgacggaatatacacgggcgaaatttttgcaggacccgtccgtcaaaacacctgttttcgtccgtttctcaacagtggcgggctccaaggggtcagctgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatccctcgaagctatcggatgatggagggcttcggcgtgcatacgttccgtttcgtcaacgagaaaggaaaagcgcgctttgttaaattccactggaaacccgtgctcggcgttcattccctcgtatgggatgaagcgcagaaaattgccgggaaagatcccgatttcaaccgccgcgacctatgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggccggcttttctcttatacagatacacagctcatccgtcttggcgggccgaattttcacgagattccgatcaatcggccggtctgcccgttccataacaaccaatacgacggctaccaccggatgacgattaataagggccctgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggatgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgacgcatgcaaacaggcgggagtcagagccgatatcatcagtcctgtgcttggaaccgttaagggagaaaacggcacggagctcgaagcgtcagccacgttcctgacagcggattccgtcctgtacgacgctgttttcattccgggcggaaaacaaagcacagacagcctcaaagcccaaaaatcggccagagacttcgtcaacgaagctttcagccattacaaagcgatcggcgcctccggtgaaggaaaagaacttctcgccctcgccgccggaaccgaaagcggccccggtcttgttccggacggaaaccatgaacaatttctgaaagccgtggctgagcatcggcattgggacagaaacgtataagaatgaaaaagcgcctttgatgagaggggcgcttttttcttgtgaaagaatattgggagaaaacgaaaattgcttccgtacaaatccgtatcttccgctgtcctggacattcagacaacagttttagagagtcagggcatgcgctatttaaagcaggcgggttgatgaaataatagtttcaccctctttggtttacttccgccctgtgtttgtgtatcttaggggtagattttctggaggagcgattgatagtgaagccgtttaccgaaaaacaacttgaagaatattaccggcgtgacgaaaacatgatgattttggtgtttgcccaatggtgcgtcaatcatgaccttgatccgatggccatttacagcaaagcttaccccggacagcctttaaacgaagagctgcgaaaaacggctgaagagcttgtcgtgccgaaggaggaatcagaaccgattcctgatcaaaccgtcatcggcgttttggagatgttcggcaactccgatttggcggaagccgtttatgaagccattgcgcaaagaccttcacggtaaaagaggcgtggattatccatgtctctttttttcatggagaaaatgtgaaagaaggcccagaaacaatttgctgatctgcgctgtctatagagtgtaatccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaactgcaaagcccgtcgtcaaaagccagacgtataagcatgtaaagcagctgacgtaccccgaggtcacaaatacgggaaacgcatcttttgaaaagaaaatcaatcaggacttcaaacgctatattgaaaactcgtaccaagaatatgtaaaaaacaaaaaagacggtgaaaaacaaggctacaaagcggaataccaggcagatttcaaggtgaagtataatcaaggcggcaagctcagcattcagacggaaaactacagttacacaggcggcgcacacgggctgacagccgttcagacctttaattacgacctggccgcaaaaaaacgggtcacactcaatgatgtgctcaatacaaaaacgaaagccaacaaaacgagagactatctttacggctacatcaagaaacatgacgatctgtttgaccaggacgtcaaaaaacaagagatcatcctgaataacgaaagacctttcttctttacgaaaaacggcattgccgttgtgtttggacaatatgatctcggaccatacgcggcaggaatccgggacgttttcgtgcctgcatccgtctatcaataaaaaaaagcgatatcactctaaaacggagcggtatcgctttttttattttaccagacaaacaatccgacaatcgccgcgctcaataaggaaacggcaattccgctgacaagcagcttccagacgttttttccgatgatggctgacttttcaccatcaagcagagattgataagatccgtagatcataccgatggtgctgaagtttgcgaatgatgtcaggaatgtcgtagccacggcaatcgtgtgcggcggaagtgatttcagctgccctttcagatcggccattgccacaaattcattcgtcgcgagcttgatgcccatcagctgtgcgacatacatcgcgtcatgtacgcctaatccgagaaggaaggcaaacggactgaagatgtatgagaaaatcttttgaatggtcaaaccgtgcatgaacagtccgagtacgccgtttaacgcagccgttaacgccacatatccgattaccatcgctaaaataacaatgaccatgttcatgccgacaagcatactgttagaaatcgtggagaagaagtcttttttctccgcttttgaaggaacgtaaataatatcatcctctttagaaacgtccacgggattcagcatattggcgattaaaagcgcgtttaagcaattcagcgggatagctgtaaacacataagtggacggaaccatcgtcaagtacgatccgatgatcgaaccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcggcagcaatgcgctgaagaaaaaatcaaccgtcggattggccatgatagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagaacataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgagagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcacaagtaattggattaaaaaggtataaaaagcccccgaaaaacagttccggttcattgtaaagacgggatgcagctgataaaatggatctgagggcaccgccttcaaaagacggcagaaaaggggtcattttcatgatcattcagttcattcgttacagataatgagaggtatagataaataggttaaacttccaattttgcgaggtttatttgtctatgcctttttcatttcatcggaataacgaatgaatgaggtgtttttattgacgtctataaaaagaaaacgcgcggaattactgcaatcatgccagtccgtattcaggtgtccgctatgcagttcggccatggcggtctcacaatacaaaagcttgatgtgcggacacgggcatacatttgatatatcaaagcaaggatatgtgaatttcctcaataaatcggtcaaaacccgctatgacaggcagctgttcgaagcgagacgcgctctttttgacagccgggaattttttgggccggttcaaaaggagatcgccgccatcatcagccgcattcaatctccgcaaacaacggcggcgatattggatgcgggatgcggagaaggcactcatttagccgccgtatgcaaattgcttcagcccgctttttccgtgacgggaatcggcattgatctctcgaaagaaggtgtgctgcatgccgcaaaggccttcggggatcatttggtttttgccgtcgctgatgtggcggatgcgccgtttgccgacagctgttttgatgtcgtgatgtctgttttatcaccttggaattacaaggaatgcagcaggcttttacgaaagggcggcacagtcattaaagcggtgccgcggcgtgattatttgaaggaagtaagggaattcttcttcggagacagtcctcggcggaatgacaccgccgattctgcggccggacgattccaagcgggctttcaaacctttgagcgcaaacggctgtgttacacgaagaccttatcgcagcctgaccttgagcggcttgtgaaaatgacgcccttaacatggaaatgtactgatgaaagcatccggcggtttatcagccgaaaagcggcggatattacgatagatatcgatattttaatcggaaccggtcctctgtaaacagaaaagacacgctgatcgcgtgtcttttttttatttccagacttcaccggcaatgttgacgacatgacgcagtttcgcccattgctgttcttctgtgatcaggtttccttcctcagtggaggcgaatccgcattgcgggctgaggcaaagctgatccaggctgacatattgtgaagcttcttcaatccggcgtttaatcgcgtccttgtcttcaagttcgccatgttttgatgtaatcaatccaagcacaagctgaagatcagagcgtttgacatagcggagcggttcaaagccgccggagcgggaatcatcatattccaggaacaatccgtcaaggtcaagcccgtcaaaaatcgtttcagccgctgcatcatagccgccttcagccgtccatgtggattggaagttgccgcggcagatatgcatcgtaaccttcagatcgtcagggcggtccttgatcgcgtcattaatggaagcggcaaacagcttgcgcagctcatccggcgttgtgccgaaatcttcaatctgacgaagccccgcttcagataagaaaacggcccatgcggtgtcatcaagctgaaggtagcggcacccggcgtcatagaaagcctgaatcgcttttttatacgcttttgacacatcgtgctgaaattgtttgtaatcattctggtaggccgctttttccaattttccgcggaaaaacagcatattcggacttgggatggtcattttcggaacagcatcgccggcaatgctgtgcaggaatttataatcttcgagcatcggatgctgagaaaaatcaatatctcccgttactttaatgccgcgcgctttcgtctgtacgttgtgaaactgaatgccgctttcaggcgtaaatgcctcaaccccgtctaaattttcgagaaaatcaaaatgccaccaggcacggcggaattcgccgtcagtcacgacattgaggccggtttctttctgcttttccacgctgcggatgatttctctgttttcgatttcgcgcagctgttctgccgaaatctcacccgccgctctttgcaggcgggcttgcttcacagccgccggccgcagcagacttccgacctgatccgcgcgaaacggcgggttttttcttagaagagtatgcaatggttgttctgtgttttgctgtgacatgaacgattccttctttcctgatgaaatgaaatataaaaaaactcttccctcggatagggaagagcttgcgtccgcaaatctcaaccttatcttcaggatttagcaccattctgctgaacagcggttgccgggtatcatagggccagtccctccacctctcttgataaggaaatatgctatttttcagaataaactgtaatactcttaatcttagtatgttttctcatattgtcaatatatttcgataaatatttttatttgtcaccctcaaatagaatcatatctatcacgatggcgatcgcaagacaaagagcaatatcctcttccttttcaatctgcaaatgataggaatcgccccagctcatccatgatttggtgacggtcatccggtttgattttccgtctgtcacttgaaaattccggccccacacatcgccggtaagattccagccgagtccggaaatttcaaatttcggtttgaaaaacgtgactttcttgatgacttggcagacgggtttgccgctgacggaaatctcgtaacggggaacgagcgacatcagtttctgattgacgctggcgagcgtgcggccgtccaaatcagtcagcttcagttcatcaccgaatgaaaacagctttccttcaacattgtagacttcttttccgctttcaagaaacacttgaaaacgattcttaaacgtaaacattcgctctttgatgtaaaaatggtacataaaaaaactccttttttatgttttacgaaaaaaggaggcggaaggtttcatatcggccgggtgcataaaaaaaggctgccgattttgcggcagctgtcgtttttatgatagcggcatccggcgtttttgacggatcgcatttaaatcaatgatgttattcgtgtcggcagctgtcaccagcgggcttgtctttggcgttttccggcggttgtccttactgaaagagaaaacaagataccctgtcaaagcagcgaaaataagtagcatcattttacatacctcccaaaaaaagttttggtattattattgtacgaaaaaacaaacgaaaagtattcaaacaattgtcacttttttaaaaaataacgtcattttccgtaaaaataactatgggttgaagaaattttgctcttgttgtggttctatagattgtatcggctgatgaatgatgatcgtttatataactttattactattttttgtaagtgtctaattaactacttcggtgttttcgtttgccttgtgttattcagtaccctaaaaaaccttatgatatgcaaaataactgcttctaacagatgactgcgagttgacagcgctttctttatttttttaaagaaaacgagatgttatcttaaaaaaatcgtttgaacattttccgcagttttttaaaagggtttgattttgtctccagtacacgcgggtcttttaaggtttttttcaattctttcgctacagtccctcttgccatagtcttcactccttctttccatttcataccttatatacggaaagaaagaaggaaaggtttcatgtgaaagaaaaaaaccaaagcagggggctttggttttaagcgcgctcttcaaagagcctggcgatttcaacaatgacgtttaccgccttttccatatgatcgacggaaatgtattcatattttccgtggaagttttggccgcccgtgaaaatgttcggtgtcggcagtcccatgtaagagagctgtgagccgtcggttccgccccggatcggttcgataatcggttcgatgtcgaggtttttcatggcttgatacgcgacatcgactatctctttgaccggttcgattttttctctcatgttgtaatattgatcacgcagttcaagcttgatgctttccttgccgtatttggccgccagcgcatcggcggttttctgcatatattcttttcgttctgcgaagcggtctctgtcaaaatctctgatgatgtacgacagggcggcttcagaaacgtctccgtccatggaaagtaaatgatagaagccttcatacccttccgtatattccggcgcttcttctttcggcagcgcgtgatgaaattccatcgcgatttttgaagcgttgaccattttgtttttcgccgttcccgggtggacgctttttccgtaacaagtaagctttgcggcggctgcgttaaagctttcatattgcagttcgccgagggggcctccgtctatcgtgtaggcgaacgcggcgttgaagcggccgacatcgaatttgtgagggcctctgccgatttcttcatcaggcgtgaacgcgacccggatcgttccgtgcttgatgtccggatgtttgatcaagtacgccattgccgtcatgatttcggcaatgcccgctttgttgtcggctccgagcagcgtcgtgccgtctgttgtaatcagcgtctggcctttatagcgggaaagttccgggaattgctcaggcgacaggacgacattgagtttgtcattcagaacgatatcatgcccgtcgtagctttcaataatctgaggattcacattttttccggtaaaatcggtcgcggtatccacgtgagccagaaaaccgacagtcggcacgtctttatccgtattcgccggcagagtcgccatgacgtacccgttgtcatcgactgtaatttctgtcatgccgatcgactttaattcatctgccagcatgttggccaatgtcagctggccgggggttgaagggcagttttcattgttttcgtcagactgtgtatcgacttttacgtaagaggtaaagcgttcaatgatttcatttttcataccgtcatctcctttgtcttatcttaccatgcgcgggggagggatttctatttcacaacccgtttgaatcgagggctctgttttttacgcgaatgaaaataaattatgaagaaacgatgactaaacgattaaactttttggaaatggatgattgaggaagaaaaaaccgatataatatggtcaattcattcaataggggaggctttcttcatggcgattttagtgacaggcggagcgggttatatcggaagccacacatgtgtcgagctgttaaacggcggctatgacatcgtggttctggataatctgtcaaacagttcaccggaagcattggagcgtgtgaaagacattaccggaaaagggcttgtgttttatgaagcggatctccttgaccgtgccgccgttcaccgggtgtttgctgaaaatgagattgaagccgtcattcattttgcgggattaaaagccgtcggtgagtctgtggctgttccgctccgttattatcataataatctgacgggaacgtttattttatgtgaagccatgcaggcacacggtgtgaaaaaaatcgtcttcagttcttcagcgacggtttacggcgttccggaaacaacgccgatcactgaggattttcctttaagcgccaccaatccttacgggcagacaaagctgatgctggaacagattttacgcgatctgcataatgcggactctgaatggagcattgcgctgctccgctactttaatccgttcggcgcgcacccgagcggccggatcggagaagacccgaacggcatcccgaataatttaatgccgtacgtcgcacaagtcgctgtgggcaagcttgagcgattgcaggtgttcggcaatgattatccgacaaaggacggcaccggcgtgcgggattacatccatgtcgttgaccttgccgagggccatgtcaaagcgctcgaaaaggtgctgaacacaacgggcgccgacgcctataatctcggcacaggaagaggctacagcgttctggagatggtcaaggcgtttgaaaaagtatcaggaaaagaagtgccgtaccgttttgccgaccggcgcccgggagacatcgccgcatgcttcgcagacccggcaaaagcgaaggctgaattaggctgggaagcaaagcgcgggcttgaagaaatgtgcgccgactcttggaagtggcagtcctccaatgtgaacgggtaccaaaaggtgtaaaaagaaagagaccttcaaatgatgagggtctcttttgttatgatgattatttaattttcacttcaacatcgttgctgaactttaatttccaagtgcctttagagtatgcgtttttatccacttcaaaagcttttacgtcagtcactttaatgttcgggttcaagtcacttaaaattttactgttgtctacttttgtttctgttgcatagcttgaagaagcatcaatatctgaatcataagatgttcctttagaatctactaatttcgctcttggaatggagaaagagcttaacggcttgtttgaaacatttttaaccgtgtattgaacagctacgataacgccgccgtcagacgcttttttctcgacaaattgagagcctactgaatctcttttttccactttcgtaacagtaacttcagttttctcagtcttaacagtgtcaccgatgttatacagtttttctttagattccgcagcttttgaagacgcagttttagatgacgaagaaccgcctccgccgccgatgtttacgagaatgataataaccaccactgccagaagcaatgtgatgattttatgtctcatgaaaaagtttctctgatctttaccgcagtttgggcattttttaacgcctttagcgatttctttgccgcatgccttacaagacaccaggttgcctgccataatatttcctcctatgtaaactatttcttaaaaactacatactataatgcctgtaaaataacctatagtcaataatattttgagaaaaaaagtattttaatgattttttagtcatgtattttaaggtcctttttagtatcggcagatcgttcgcattttccataggtttaatgaaaaaagagtggttgaacatgttcgtgatttcccgtataatcttgaaagataatataaaaactgaacataaaaaacagtggttttctagggttccgcaatgctgaattggtctggaccgagagaaaacacacagcaggttcctgctgtgacacgttgggataaaagcccgggagtttctgctcttttaatgaagagtgctctcccgggcttttttgattttataaaaaagggagtgtctgggatgaaaaagagattgctggatgtgctgatgctgattattggagcttttatctttgctttggccgttaatttattcgccattccgaatgatcttggagagggcggggtaacgggaatcaccctgatcttgtactatgtgtttgaatggtcgcccggggtgacgaatatcattttgaacgggattttattgattatcggatataaatttttagacggaaaaacaacgctttatacgatcattaccgttgtcgccaactcactgtttctgcatctgacgcatgattggcactcgccttcacatgaactcattattaatactatttttgcgggtgtgtttgccggtgtcggaatcgggatcattattcgagtcggtggcacgactgcgggttctgccattttggcgaggattgcgaacaaatatctcgattggaatatcagctatgcgcttttgttctttgatctgattgtcgtcttcagttcttatttcatcatcggtgcggaaaaaatgatgtttaccattgttatgctgtacatcggaacgaaggtgatggactttatcattgaaggcctgaatacgaaaaaagcggtgacaattatatctgagcataagcacgaaatcgctgaacaggtcaacacgctgatggacagaggggttacgctgctgtcgggtaaaggaaattacacggggcagtcgaaggaaattttatatatcgtcatccagaaacaagagctttccatgctcaaaaaaattattaaaagctgtgatacaaaagcgtttgtcattgttcatgatgtgcgtgatgtctttggtgaaggcttcgtcgatatctctaaataaaaaggatccctctgccggcgcggagggtttttttcttatgccggcagaagcggttatatccgtttcccgggaaatagcctgaaagctgtttcttaaaacgaagtggatacaatcggccggacgttttatactgaaaatatgatagagcgatagaaaggagcgcatatgaacccgttattggcaatttacccgagggctgtgttgtctgatacgtgctgtacggcggaggatgtcttttgcttttatgatgagaaaaggcgggtctatgtcgccattccgaaggaggatatcaccccgaaggagaaactgcttctggaatcatttttgacgcccgctgaagaaaaaggcgttttttttccggagacggcggcagcaaagaggtggcggcgttttctgctggaagaaggtccggtgcctgatgtcaaggagccgcgtgtccgttttatccattatgacttattgggagaacgggactggggggcattcacagaagcgctgcgccatttctggccggtttcatatacagttgtccggacggggagggatcatggcgtgattgtggaggaagaaaagctggaagcgccagattcggatgacatcgcatcttttgtgaagattctcgaaggcgatttttatttcagtgtccgttttttcgtcggaaggtattactgcaagggggaacgtctgcgccttcattatcagagagaacagcaatattgtcagatcggccggcgtcatctcccgcagctgagcacgctgaccgcggaaacggtatttccggccatgctcacggaggaaagcagagaaaagctctcagccttgcttcacgaagaagcggcgctgctgtttcagaaagaaccggagctgaagcatacgattcagacttttattgaacataactcaaacatgtcgctcacatcgaaaaaactgcatttgcaccgcaacagtcttcaatatcggattgataaatttgcggaacgctcaggtattgatattaagacatatcggggcgccctgctggcttatttcatttgtctgcaatatgaaaaatcacattaaatgggaaatgtgcacgaagacagcggtctttttttatgaacattgcctatatccgccgccgtctgacgctgttacaatcctatttaagaaagcgtttacaaataaagggggatatacatggcggaacttcggctcgagcatatttataagtattacgatcaaaaagaagcggctgtcgatgattttaaccttcatattaaagataaagagtttatcgtgtttgtcggtccgtcaggttgcggcaagtcgacaactttgcggatggtagccgggctggaagacattacgaagggcgatttctatatcggtgacacgagagtgaatgacatcgctcctaaagacagggatatcgccatggtgtttcaaaactatgcgttatatccgcacatgacggtctatgataatatcgcattcggtctgaagctgaggaagatgccgaaaccggagattaaaaaacgtgtcgaagaagcggcgaaaatgctggggctcacagagtatctgcaccgcaaaccgaaggcgctctccggcggacagcgtcagcgggttgcattagggcgggcgattgtcagggacgccaaagtgttcttaatggatgagccgctgtcaaatctggacgcaaagcttcgggtgcagatgcgggcagaaattattaagctccaccaaaggctgcaaacaaccacaatctatgtgacgcacgaccaaacagaagcactgacgatggcgacacgcatcgtagtcatgaaggacggaaaaattcagcagatcggcaccccgaaagaagtgtatgaacatcccgaaaacgtatttgtcggcgggttcatcggttctccggcgatgaactttttcaaaggaaagctgacggacggcgccattcagatcggttcagccgctctcagcgtgccggaagggaaaatgaaaatgctccgggaaaaagggtatgccggcaaagatatcatcttcggcatccgcccggaagacatacatgacgagctgattgtggtagaatcttataagaattcatccatcacagctaaaatcaatgtcgcggaattgcttgggtcagaaattatggtttattcccggatcggggatcaggattttatcgcccggattgacgcccgccatgacattcgtgccggtgaggaattgaccgtcgctttcgacatgaataaggctcacttttttgacagtgaaacagaaatcagaatccgctcataacgcaaagccggacagctggatgtccggtttttttgatgtaacaatttatgacgcataaccgatataaaaagtaaatagaagacagaaagcaggaaaacgatgaaacgcatgatcatgtgcatgtgccttttggctgccgtgtttacacttgccgcctgctcgggtcatgaggcaagcgccgaacaaagcattccgaaggcagaagcgcacagcgaaaaaaagtccgtaaagcggcaaatcaaaaaagagccggatacgtccgcctgggttcaaacgaaagggatggcgagactgccgattctgatgtatcacagcatttcagagggaaacagcctgcgtgtgccgaaggaagaattccggcagcatatgaagtggcttcatgatcacggctattatacgatgactcctgaagaggcctatctgatgctgacggaggataaggagccgcgtgaaaaatgtgttctggtcacatttgatgacggctatacagacaatgtgaaagcggcctatcccattttaaagaaatacaagatgaaagcgacaatctttatgatcggaaactttatcgggcataagaatcatctgactgagaagcagatgaaggagatggccgcccacggcatttccattcagagccatacgatgaaccatctcgaattgaacgggctcacaccgcagcagcagcgacgtgaaatgaaggactctaagcgtttatttgatcaaatgttcgggcagcggacgtctatgatcagctaccctgtcggacgatataataaagaaacattaaaagccgccgcctcgtcaggctaccgtatggcggtcacgacggagccgggagcggcgtctagagatcaggggctttacgggcttcaccgcgtccgtgtgtcgccgggcatgtccggcgcggcattcggctcttatattcaaaatgtgatgaaataacagagcctccgcatatgcggaggctttttttcagtttaatagaattgatgaagcagcagaagggtgacgctcacggtaatcgctccgccgattctggtcgacacttgggcgaacggcataagctcaagccgttcagcggcgctcaagatcgcgacgtcgccggtgccgccctggccggaatggcaggcattaataaccgccgtttcaatcgggtacagattcagccattttccggtcagaaaaccgacggccatcatcgtgacgacgattgataaaatggtaatgatgttgctgattgtaaacgccgcaatcagcttgtcccacggtgtcattgaaacgccgatcgcaaataagagcggataggtcacggctgtcgagaaaaagcgcgagacgccgaaggctccgttttcaatcgaagccggcgccagcctgaacagcttaatgagaacggcaaggacgagcatcacgactggagccggaagctgaaagaaatcatgcgccagcatgccgaccaaataaagggaaaccgctaaaataccgcccgaagcgaaaaaggacaaatcaaacgttttatcatcggccggctgttccaatgcgggagcggaatgatcagacttatcaaccttcccgttgcccgtccattccggtttgcgtttcccgatgacattcagcaaacccgataacataatggcgcacaggctgccgagcatgatggacggcagcacaagcgcaaaggcgtctccctgggacatcggcataatatcggagtagccgatggataaaggaatcgcgccttcaccgacaccccccgccataatcggaacgacgatataaagcagcgtgtgctgaaagccgagcccgagcagcgtcccgacgcataagccgacgatggcggccgcgatagacccggcgatcagcggaataaaaatcttaacgaaagctttgacgagcgtctctcttttcatcccgagaatactgccgacgacgataccggcaataaatagatagagaaagttggagctttccgtgaattctgttgttgaagtaataatgtctttcggaagcaggtggtagtagacgacagcggatggaataaaggttgcgagaatcgcagggccgccgatggaccgcacgatcggaatggattttccgatctggccgaaggtaaatccgaaaaaactcatgacggcaattgatgtcagaatgtcgctttttacatcacggctcatgacaaacaccgtaataagcaagaaaagcaggatatagataggaagaggaataatgccgattcttatattcattgctctggcaaaccagttatcagtccgttcctgtttttggattgaatccgtttgcaattttggttgaagttctcccatgcttgttcccccagtcgttatgtagtgaaaaaatatccccatttaaagtatactaaaaaatttaaattgttcatatattatgaatttactagaggacatgctttcttcacattttctttctcaaaatggcgatttggcgggctttttcaccgagaaaagcattttgttcgccacacgaataaaaaagaggtacgatatcaaagggacaaatatcctaggtgctgacataaaatctctacaaatccgacaataatcagtcacaatttcagcctgattttaggtatattgatctttttttttgggctgaatcgttgtaaagtaatgatattgaatcatttctatgacagccgctgtcccccagggtgtacaggctgatatttcaatagttttgacgaatttgtgaaacattgagcaaatatatcattttttgtgaaataccgagcaatgatttcactatgtttgtgaaatgttgagcaatttaccagattggaggaaaaacatcatgagtgagttggtattagcccgcattcaatttgcatctacaacattgtttcacttcttgtttgtgcctatgtctatcgggcttgtgtttatggttgctttgatggagacgctttatgttgtcaaaaaacaagagacctatctcaaaatggctaaattttgggggcatctctttttaattaactttgctgtcggcgtcgtcacagggattcttcaggaattccagttcggattgaactggtctgattattcccgttttgtcggggacgtatttggggctccgcttgcgattgaagcgcttttggcgttttttatggagtctatttttatcggattatggattttcggctgggaccgtttatctaaaaaagtgcatttgctttgcatttggcttgtatccttcggaacgattatgtcatctttctggattttgacggcaaactcattcatgcaggagccggtcggctttacgattaaaaacggccgcgcggaaatgaatgacttcggagcgcttttgacaaaccctcagctttgggttgaattccctcacgtcattttcggagcgcttgcgacgggtgctttctttatcgccggtgtcagcgcatttaaattattgaagaaaaaagaagtgcctttcttccataaatctttcaagctttcgatgattgtcggtctgatcgccggtatcggcgttgcgttcagcggacacatgcaggctgagcatttaatggaatcgcagccgatgaaaatggccgccagtgaagcgctttgggatgacagcggtgatcctgccgcgtggacggcttttgcgaatattgatacgaataaagaaaaaaacacatcagaaatttcaattccttacgcactgagctacttggcttaccagaagttcagcggcagtgtgaaagggatgaaaacacttcaaaaagaatatgaaaaaacgtacggaaaaggcgactatatcccgcctgttaaaacgacgttctggagtttccgcattatggcgggagcgggtgcgcttatgatttttgccgcgattgcaggctttattctgaaccgccgcaaaaagcttcatacgagcaagtggtatttacggggcatgatcgcactgatcgcattcccgttcattgcgaactctgccggatggattatgactgaaatcggccgccagccgtggacggttatggggcaaatgacaaccgcacaatccgtttcgcctaacgtaacgacgggatctctgctgttttcaattatcggtttcggcgtcatgtacttgattttaggcgcgctgcttgtcttcctattcgttcgtgaaattaaaaaaggtgcggaccatgatgatcacaaggatgttcctgtatcaacggatccgttcagtcaggaggtctaccatggggtcacttcatgatctttggtttgtactcgtttcagttttgtttgtcggatttttctttttagaaggttttgatttcggtgtcggcatttcgacccgatttcttggccataatgaattagaacgcagagtgctgattaacaccatcggcccgttctgggatgcgaatgaggtatggctgctgacaggtacgggagcgatcttcgcggcattcccgaactggtatgcgacgatgctgagcggatattatattccgtttatcatcatccttcttgctttaatgggccgcggggtggcgtttgaattccgcggaaaagtgaatcatttaaaatgggtcaaaacatgggactgggtgattttcttcggcagccttatcccgccgtttgtattcggccttatcttcacaagcttgttccgcggcatgccgattgacggccatatgaatatgcatgcgggtttctcagatattgtgaacgtgtattccgtccttggcggagcagccgtcacccttctttcattcctgcacggtttaatgtttgtcacactgcgcacgatcggtgatttacaagagcgtgcgagaaaaatggcaaaacgcgtaatcggtgttatctttcttgttgtacttgctttctttgcgatgtctgcatacgatacggatatgtttacacgccgggcaaacatcacgattccggtattcgtgctgattgtcatctgcaacgttcttgctgttgtgttcatgagcaagaaaaaagacggctgggcattcggtatgaccggcgcgggtcttgctttgacagttgcgatgatttttatctctctgttccctcgcgtcatggtcagctcgctgaaaagcgcgtatgacttaacagtagctaacgcgtcttccggtgattattcacttaaggtcatgacaattgttgcactgactctgctgccgtttgtcatcggcagtcagatctggagctattatgtcttccggaaacgcgtcagccataaggagcctatgacttattaatgggaaaagacctgtttctttataaaggaatgaagcggattcttgcgatcattacgggattaacgattatacaaacggccgccatcatcttgcaggcggaatggctgagccaggcggtaaccggattatttaacgggaagcggattgcttctctttatccggttatcggctttttcctgcttgcgtttttggtccggcatgcggtaaccgcggtccggcagaaaatcgtgtaccaatatgccgcgcaaaccggcgcagacttaagaaaaagatttcttgagcaattgttccgtctcggcccccgctttgcgaaaaaagaggggacgggccggatggtgacgctggcgatggaaggcatcagccagttccgccgttatttagagctgtttctgccgaaaatggtcagcatggcgattgtgccggcggccgttgttatttacgtgttttttcaggataaaacatcggctttgattctgattcttgcgcttccgattttgattgtatttatgatcctgctcggacttgtcgcacagaaaaaagccgatcgccaatggaagtcctatcagacgctttccaatcatttcgtggattcgctccgcggactggagacattgcggtttttagggttaagcaaatcacacagtaaaaacatctttcatgtcagtgagagataccgcaaggcgacgatgagcacgctccgggtcgcgtttttatcatcattcgccctggatttctttacgatgctgtcggtggcgacagtggctgtgtttctcggcctgcggctgatagacggacaaattctgctcggtccggcattgacagcgctgattctcgcgcctgaatattttctcccggtccgcgaagtgggaaatgattaccacgcgacgttaaacgggcaggaggcggggaaaaccattcaagcgattttggcgcagcccggttttaaagaagaaaagccgctcgaacttgatacgtggactgacggggatgaattacagcttacgcgtttgtccgtccgagaatcgatgtctgaatttcatctgtcctttaaagggaagaagaaaatcggaattatcggggaaagcggtgcgggaaaatcgacactcattgatgtgctgggcggctttttagagcctgcgtccggtgagatcaaggtaaacggtgaatcccgctcgcatctgcagtcagacggctggcagaagcagctgctttatatcccgcagcatccgtacatttttgatgacacgcttatgaataatatccggttttatcatcctgatgcttcccgtgaggaaacggcgcgcgctgctgattcagcgggtctttccggactgatccgcgatctgcccggcggccttgacggccggatcggcgagggcggacgggcgctcagcggagggcaggctcagcgtgtcgcgctggccagagcctttttaggaaaccggccgattctccttttggatgagccgaccgctcaccttgatattgaaacagaatatgaaataaaagaaacgatgaaagacctgtttgaaaacaaacttgtctttctggccactcaccgtcttcactggatgcttgagatggacgaaattatcgtgcttgatgacggcgcggtggcggaaatcggcacccacgacgaattgatggcgaaacaaggcgtatatgccaaacttgtaaaggcgcaactgggggaaagaacatgagaaaagaagaatggattctgccgtatataaagcaaaatgcccgtttgtttgttcttgtgatttttttaggcgcggtgacgattttttcggcggcctttctcatgttcacttccggttttttgatctctaagtcggcgacaaggcctgagaatatcctgctggtgtacgttccgattgtggccgtgcgcaccttcgggattgcccgttcagtctcacggtacgccgagcgcctgacggggcaccatatcattttgaaaatcgtgtccgatatgagggtgcggctttacaatatgctggagccggcctcgctcatgctttcatcccgttttcggacgggcgacatgctcggcattttggctgaggatattgagcatttgcaggatgcgtttttaaaaacgattttcccggcggtttccgctttgctgctgtatgcggcatccgttatcggactcggctttttttcctggccgtttgccgcttttgcggcgatttacctgtttatattggttgtattgtttccggttgtgtcgcttcttgtgacgagagcgaaaaacatgaggctgaaaagcggccggaatacgctctacagccggctgacagatgccgtgctcggcgtgagcgactggatgttctcgggacgacaggcggcctttatttcctcttatgaagagaaagagaaggcatggtttgaccttgaaagcaaacgtcagcggtttacgagatggcgtgatctcgccgcgcaatgccttgtcggcggcttcatattgatcatgctgttctggacggcgggtcagtatgcggacggcagcatcgccaacacgatgatcgcagcctttgtgcttgtcgtatttccattgacggaggcgtttctgcccctttcggatgcgctgacggaagtgccttcttatcaggattccatcaaaagaatgagtaaggcggctccggagctgcgaagtcgtgaggtgaagcagacagatgagatactggatgtatccgatgtgacacttacatttgataacgtgacgttttcttatgatcagcacagtcatgtgcttgaccgtttttccttcactctccgccagggggaaaaaatggcgctgctcggcaggagcggctccggtaagtcgacctctctcgctttaattgaaggcgccttagttcccgattcgggcaaggtgatgctgaacgggctggaaactgcggccgtgcaggagcagatttcctcagcggtggccgttttgaatcagaaacctcatctctttaacacgagcattatgaacaatatccggctcggaaacggcaaggcgagtgatgaagatgttaagcgtgcggctcggcaagtgaagctgcatgattatattgaatcactgcctgacggatatgaaacgtccgtgcaggagacggggattcgtttctcaggcggggaacggcagcggatcgcgcttgcccgtattctgctccaagacacgccggtcattatccttgatgaaccgacgatcggccttgatgcggtcactgaacgagaattgcttgatacgatttttgatgtctttaaagagaaaacgatcctctggattacacaccatttagcgggtgtggaaacagctgataaaatcgtctttttagaaaatggaaaagcagaaatggaaggaacccatcaagagctgcttgcagaaaacgaacggtaccggaagctttaccgtcttgatgttccgatcagaacataaacagccgcaaacgagcggctgtttttttgtgcggtttaaaatctcttcttgtttggaatataaataggagacagaagaggaggtacagagatgaatataatggattggacggaacaggatgtgaaagatacgctgccgaaacgggaggcggacagccataaaggcacgttcgggacggcgttattgctggccgggagcgatgacatgccgggagccgcccttctagccggattgggtgcgatgagaagcggtgtcggcaagctcgtcatcggtacatcggcaggcgtcattccgcttatcgtcccggtgctgccggaagccacgtactggcgggacgggtggataaaagccgcggcgggccagcccggggaaaccatccgggccgctgccatcgggccgggccttccccaaacagacgaggtgcagcaggcggctgatcagctgctttctggcgattatcccgtcatactggatgcgggcgccattacgaaaagaacctatccgaagaggaaagctcccgtgatcttgacgcctcatcccggcgaattttccagaatgacaggccttccgattcaagagattcagcagaacagagcggaatatgccgcggaatgggcggagcggcttcatgtcacgattgtcctgaaaggaaacgaaaccattatcgcttttcccgacggggaatgccgcaggaatacaaccggaaacggcgcgcttgcaaaaggcgggaccggcgacacgctgtcgggaatgattctcggcatgctgtgctgtcatcaagacccgaagcacgccgtattgaacgccgtccgccttcacggcgaatgtgcggaattatggacgaaagagcgctccgcccataccttattggcgcacgaactttctgaactgctgccgggtgtatggaaggaatatgaataaagaaaaggcgtcttcatagggaaggcgcctctttttgttttaaccttgatttcatcaggacataatacagcagcgacggaacggccaggccgatgacccaggcaatgtcgcctccgccgaatatttcagcgagcggcccgatgtaaaaggatgtattgatgaacgggatttctaatataatcgacaaaacgaaggcggccgctgtaatccaattgaccctgccgtattgtccgttgacgtcaaacatcgatttgacgtggtattttccgcggcggataaaatagtaatccacgaggttgatcgccgtccatggaattaagaaataactgatgaaaaagatgaaatttaaaaacagttccatgaaattgctttggcccaagagacttaatacagtacccgctgccgtcacacaaaggatcattaccactctcgttttcggcgtcaccttcagttttaaaaacggctccaaggtagtcgtggttgacataaaggctccgtataaattaaagacgttgatcgccatttgcccgaacaggacgatgatcagcataataaaggaaaacggaccgaacaatcggacaatctcatttcccgcattagcggtaaattccgggagcgccgtcgtcaaaatggcgccgagaagcatcatccagatggaactgactgacgtacctgcatagctgtaccaaaaagtatgcgatgccggtgttttgaccggcagataacgggaataatctgcgacatatggcgcgtatgccagctgccatgtggccaccgcgctgaccgccactagaaaaacaggcagatctaatgagccgggcacccagcttcctgaaggaatcggcagttgaaaaataagaatcgttgcagcaaaaaaaacggcaaaggaggtccaagagaggattttctgcattttgtgaatcagatcatgaccgtagatcgtgagtaaaaaacagatggcgcttaagccgataatacaccatgaagccggaatcgggacaaagctgctcagtgtaccggctgcgagaatcgtactgctcgcaaagaagcccaggtagataaacatgaccaaaaagagggcagaatcgctccgatcacgccgaattgcgcgcggctttgaatcatttgcggaattccgagctgaggtccttgtgcggaatgagacgccataaagattgcgccgataaaggttccgatcacaatggcggcgatactccaaaagagatcgagtcccattgtaacgggcagtgtgcctgtgactaacgtcgtaatatgcatattagccccgaaccagacggggaataaatctttagcctttccgtgtctttcgtcatgcggaatatgttcaatcgttcgcctttctactttcaatagataatctcctccgtatgttcttctttaacataaagacatagcttaacagattgacctgccgtttacaaattccagcatgcaggaaaaacattgtaaagcctcgctgacagccgttcaaagttttttgaaaaacggaacaaacactgccgcctaaacgatttaccagggattaaaaggtatggatatgcttactgactaatatgtatgaaggagaaatgtgtcaatcttttgacgaatggagccattattcgttaagctgaaagaatagtttactttgtgtaaatttcattaatgaaaaggggattgatgatatgtgtacaagtcttacattgaaaacgacagacggcaatcacctattggcgcgaacgatggattttgcatttcagctcggtacggacgtcgtgctttaccctcgtcagtacagctggaaaagcgaagctgacggcaggatgcataagacgaaatacgcatttatcggcatggggagaaatctcggcaatgttctgtttgccgacggcgtaaatgaaaaagggctgtcgtgtgcgacgctgtattttccgggctttgcgggatacgagaaagcggaacgggagggcacctgtcacatcgctcctcatgagtttgtcacctgggccttatcaaactgtgaatctcttgaagacataaaggaaaagctctcaatgctgacgattgtagagaagaagttaatgttattggatacggtgctgcctcttcattggattttatcagaccgcacgggcggctgcattgtcatcgagccgacaccggagggaatgaaagtatatgacaacaaacccggagtgatgaccaacagtccggaatttccttggcatgtgaccaatctgcgccattatatcggaatcaggccgcagcagtcagaaagcaaaacattgggcggaatgacattaaccgctttcggccaaggatctggaacgatcgggcttcccggtgattacacgccgccatcccggttcatcagagccgcttatctgaaagagcatttagagcctgccgctcatgaaacggatggcgttacggccgcttttcacgtgctgtccaatgtgaatattccaaaaggcgcggtgatcacagaggagaatgaaattgattatacgcaatatacgtcggtcatgtgctgtgacaccgggaactactactttcatctgtacgacaaccggcagattcacaaagtaagtttattccatgaagatcttgaccgtccggagccgaaagtatttgcggccgcggcggagcagaatatacaggagctgaattagctcaaaaaaaaaacaggacgcgattgtcctgtttttttatttaatacggatcagacggatggctttcctgttcagcctgttttgcggcttgtgctgtatcagtagtgccgatcggcccgccgctgctgctttcggaggcttttttcagcccttccgcaacacgttttccgtagtccggatctgcttttgtgaaattctcaatcatttgatcctgaatgtctttccggcaggaagaaagcgtattgaccaggtttgtgatcaattcggtccgttcaaattccgaaaatctgcggtatgtttcaccggcctggccgaagttattcggccggtcgatcgcttcccgcttcacatcgccttcgacatgaggtgtatggtctttcccatcctgctttgcttcggtgagtcctcccataatggacggctcatagttgacgtgcgggttttgtccttctgcccgatcgacccgatactgcatttgcccgccttcctggttggtggcgacatgctttttcggcgagttgatcgggagctgcaggtaatttgcgccgacgcggtaccgctgggtatctgaataggcgaatgtccgtccctgaagtaatttgtcatctgaaaaatcaaggccgtccacaagcacgcccgttccgaatgatgcttgttccacctcggcatggtagttttccgggtttttgttcagaaccaatttgccgatcggcttccaagggaaatcgtctttataccacagcttggtcggatcaagcggatcaaaatccagctcgggatgctcgtcatcagtcatgatttgcgcatacacttcccattcagggtaatcgcctttttcaatcgcctcatacaaatcctgtgtcgcatggttaaagtttttcccctgaatctcttccgcttccttctgtgtcaggttgcgtatgccctgtttcggttcaaagtgatatttgacgagcacggcttttccttcttcattgacccatttgtaggcatggacgcctgagccctgcatctgccggtagttggccgggatgccccacggcgaaaacaagaaagtgatcatatgagtcgcttccggtgattgggaaatgaagtcgaaaatacgctcgccgtcctgaatgttcgtaacgggatcaggctgaaatgcgtgcacaagatccgggaacttcagcggatcacggataaaaaagattttcaggttgttgccgaccagatcccagttgccgtcttcggtataaagcttaacggcaaaaccccggggatcacgcaatgtttccggggaatgcttcccgtggttgacggtagagaaccgcacaaacgccggagttttcgttcctttcttttgaaacactttcgctcttgtatatttagaaatctcctcgtctccaaaacttccgtacgcctcaaagtatccgtgtgcgccggcgccgcgcgcgtgaacgacgcgctcgggaatccgttcgcggtcaaagtggctgattttctccaaaaaatcataattctccaatgtcgtcggtcctctattgccgactgtcctgacattctggttgtcagtgaccggatggccctgccggtttgtcagcgtgtcttctgactcgcctttaccggtcgtcttactggaaagcgtttcttcgctgtttttgttattttccattgttgaaccctcctttttgaacggtaacaatatgcccagcagagccgttttttaaaaccgattttcaaaagaagcggttattccgcgatcggcgtcaaggacccgccgttccatatttcgcccttgttcagcgtccagctgttttgataaaggctttgcgcgccttgattggccgccggacttaattgttcatcccatgtcaaaaagtacgcggtctgagggtatttttgcctgatcgcattaataaaagcagcataatcaaagcttccgatattgccggacggaccggtttcggcaaaggcaaacggttttttcagagacagcatttcatcatagcctgatatcgcatacggatcagtgaagtaagcgtccagaccggtaatatccacataagatgagcctgggtagaagtctgttttaaagtctctgttggcatccggcgaatacacccacaaaaggttatccaatcctcttgtctctgtcatatagcggtatatcttcttgtaaagctctttgtacagcgagattctctcattgtctttttggttgtagcctgtcagcccccaccagaaccactcgccgttcatttcatgcagcggtctgaacagaacggtgacgccttgatttttcagctgagtaaggccgtcggcaattttgctgagcagcgcctcaagccgttttccttccacagttgaagggtcaaggatgtttttgtactggctgtttgagatggccgttttatagtttccggatggaaaggccggatttgcgagatgcaggctgacctgagggaggccgccgcttttccagtatgagattaagctgctgttgcagctgtaatcgatagtatcggtgatatccgctgtttccagccaccctctcccatagtcacagccgtagatggcgggagactgtcccgtcgcgtttttcaagcggttttcctctgtcattgaaaaagtgacatcactgtacccgccgaacgctccggacatgaccctgttttctgaacggttgggcaggtgggccagccagttcatgatatcttttgtcgtctgctgggcatttgggttgacgggataaacggtgtgagccgatatcggactggcggctcctaagagtaataaaacgatagacaggcagactgctaactttttaagcatataaaagacctcctgatttttaagatgatgaaggatgtgaaacgataacctcacaatctccttctataacaaaatctccggaatccgccggcacgataaagtgatcgcctttctgaacggggcatccatccagttctccgcgccctttaatgacgcttgcgagtaaataccggccgggtgcggggaatgatgctttcccgctcacatcccattgataaactgaaaagaaaggtgtttcggcgagtatcgtaataagagcatctccgatccgatgcttagtgctttttacattttcatcggtatggggaatgtctgttacgtcaattgctttctcaagatgaagctcgcgtttattcccgttcccatccgtccggtcatagtcgtaaagccggtaggtggcatcagagctttgctggatttcaaggacgagcgtaccttcacataaagcgtgcagtgtgccgctcgggacatagaaaaagtcgccgggcttaatggggatgcggcggagcaggtgatcccactcgtttcgttcaatgagccgaacgaaatcttcttttgtttgggcgcggtgccctaaaatgagctccgcgtcttttttgcagtccaacacgtaccagcattccgtttttccgagttctccgttttcatgccgatgtgcatatgcgtcatccggatgaacctgcacggataagtccatatttgcgtcaagaatttttgtgagcaggggaaaagcttcttctttcggatgtccgaacaggtcagggtgttcattccagagacggtgtaatgatgttccggaaaatggcccgttccgcacgatggatgtaccgtgcggatgagctgaaatcgcccagcactctcccgtccgctcagaaggaatctcatacccgaatgtatcgcgcagcttcgtcccgccccataatctttctttaaaaaccggttccaaaaataagagtttcgtcattttcccgcctcccggtttgccgtctctaatgcgcgctccgccaatacgagcgaaccggccgcgccggagtgaatccctaattgagggggaccgatgaagtgttcaatgtcgggcagatcaatatattgattcagccgctttttcacgtgctgacggatataagagaacagctgatgctgcttcatgacgcccccgccgagaatgatcttttccggcgaaagtatgagaatatactgcacaagcgcttcggcaatataatagccttcaagctcccacacttcctgctgatccgccagcagatatgcttttttcccccagcgtttctcaatggcgggacctgccgcgaggccttccaggcaatctgtatggtaagggcaattgcctttgtagccgtcgtccgggtgtcttctgacataaatgtggcccatttcaggatgagacagcccttgaacaaatctgccgttcatgatggcgcccgctccgatgccagtgccgaccgtcaaatagaggcagctgtccgcgtttttggccgcgccgaaagaagcttctccgagcgccgccgcattaacgtcggtggtgaagcctgcgggaatatgcagtgcgcttttgatcgtttgaagaatagggcagttccgccaggctgtcttcggcgtcgcggtgatgcacccgtatgtttgactgtcggggcggatgtcaatcggtccgaacgacccgatgccgatggcttctatcgggaaatctttaaagtaacggatgacttgtctgagtgtgtcatccggttctcccgtcggaaactccgccctgtccagaatggtgccgtctttttgtccggcggcacagacaaatttcgtgccgccggcttcaatacctccaagcatggctgtacctcctcatctgttaaaatccgttttgatcggaaacggctttgaaccagcggccgctttttttgacggtccgttcgcccccgttttccagattgacagatacaaagccgtagcggtttttataagcatttgtccaagaccagttgtccataaaagtccacaggtgatagccttttacatttgaaccttctccgatggcccgatgcacccatttgagatgttcccggataaattcaatcctgtaatcatcctgaatgatgccgttttcatcgcggaagcgttcctcgccttcaactcccatgccgttctcggaaataaaacattcgatatttccgtaatgttctctgagattggtgagaatgtcatagattcctttttcgtatatttcccacccgcggtgtgggttcattttccgtccgggcataacatacggatcgaagaaacgctcaggcaggaaaggggcgtgcggattcggaacatgttcttttgccttgacgcgtctcggctggtagtagttcacgcctaagaggtcaaccgtatgctcctgaatgaggcggagatcttctttctcgtaacgcggcagaaagccttccgccttgagaatctcgacaagctcctcaggaaattcgccctttacggcgggatctaaaaatgagcggttgaaaaaggcgtcggcaatccgggatgctttcagatcttcagggtgtgagcttctcggataagaaggcgtcagattcagaatgattccgatttgtccgtcctgtttcaattctctgtaggctttgacagcccttgcattcgacagcagggtatggaagccggcctgcaccgcttcttgaaaattaacgtgattcggatagtgaaagtcgtataagtagccgccttcaatcggcacaatcggctcgttgtgagtgaaccattttttcactttgtcaccgaatagcgaaaagcatgttttggcgtaatgttcaaacgcgtcaacggtgtcccggctgacccagccccccttacgctgaagggcgagcggcatgtcaaagtgaaacaaattgacaaacggctcaatgcgatgggcaagcatttcatcgatgacgtcctgataaaacgcgaccgctttctgattgacctcgccagttccgtccggaatcaatcttgaccaggaaatagacagccggaaggagttgtggccgatttctttcatcagccggatatcctccttgtattgatcataaaaacgtgacgtgtcgccggggccgacgccgttaaaaaaacggctcggctctttttcataccagtaatcccatatgttttggctttttccgtctttgtcggcggcgccttctgtttgggtggcggaggcggaagacccccaccagaatccttccggaaaacgatattgaatatttgattcagtcaattgatttctctcccttactgcgattttgattacatactcatgctgtcatcccgtgcttgctgctcggcctcggcttctttttcctttgccatgtttaatttgtccagcgctttaagaaacgggaaccagataataaacacaatacagaggttgaccagctgcataatgccgcccatgacggaattggtcgccataatcccgttaatgaaaagggggacggtccagggcacggtcacgccagtaggagggggcacgatccccgccgacatggccaggtaggtgacgagcgtgacaaccatcggtgcgatcacccacggaatgataatgatcgggttcatcacgatcggcaaaccgaaaataaccggctcattgacgttgaaaatgcccggcgcgagaccgagtttggatatctgtttcatctgtttgcttttcataaaaagcaagatggtgatcactatggccaatgtcattccggttccgcccattccgacggtgtaaatctccataaacggcttagaaataatatggggaatctcttttcccgctgtatacgcagccaaattttcgacctgtaatgtattccagatcgggtccatcacggaattgataatgatctgtccgtgaagtccgaaaaaccataaaatctgaataaagaaaacagcgattaatgtaggaatgatgccgcttccaagtccgacaagcggggcttgaaccgtatgataaatgacatcatgcagattggtgtgaaagatctgggtgacagccgcattgatcaagaggaagacggtaagcgtgataaaagccggaatcaatgcggcgaacgatttagcaacagccggaggaacaccggcaggcatcttaatcgttaagtttctctggacgattcttctgtagatttcacccgacaaaaaagcggttatcatgccgagaaacatcccttttgctccaagccggtcaaccggaatgacgcctgcgaccgctttgcccgtttccggctctaagacgaacggggtgagcagcagaaaagaaaccaatgcaatcgctccgccgaatacggcctccacttcgtagctttttgaaaggtaatagccgatcccgaagacgacaaaaatggacataatccccatcgtcgccgtcgaagcgccgccaaatccggattgaaagacagacagggcggagctgctcatgattttgtttaaaaacggcaggttcgtcagcacgacgaacaccgaaccgaaaatggtcagcggaaacgccagcataaaagcatcccgtaagacttgcaggtagcggttattgtttaatttgcccgcgatcggaacaaggaattggctgattttctcaaacacgtcttcacccccggctttttataaattctttgattgaaataagtcgagcatttctttgacgatctctttcattgagagcgctgacattaagtggtcttcagcatgcataaaaagcagggagacatccgtcttggcgccgccggcttctttttgaatcatctgaaaatggatgtcgtgcgcttttcccagttcttcttcagcctttgtcagaaaggtgtctgactcatctggccggccgtctttataagcgcgtatcgattgaataatacagctgcgggcattgccgctgtgaagaatcagctgaaaactgatctgttcatccgtgtacgtttccatgcttatcgcctcctttatttgttctctatcaaggaaacggcctgttcgtatgcttttttgccgtctcccatgccgtatgccatcatatcaatcacatcaacggtgatgtgaagcgggtccgcctctttctgaagctcgccttttaaaaaactcatctgcgggccgatcagtacgacgtctgcgtctttcatcgcttcttttgctttatcctgtccgactgcccaaatctcggcctcctcaccgatggagctggcgtaattctgcattttcgtcacaagaaggctggtggacatgcctgagctgcaggctaataaaattcttttcatgaggaatcccttctttcataaagttaaaacgttttcatgaatattataatcttttgaaattaaatgtctatacttttaaaatataaaagttttacttttcggatttttgacacaaaaaaaccttttaagattcaacttaaaaggtttttcatctcaagcgagccataacagccataaataaagtccgatcagggtgatgaataacgtcggaatggttaatatcagacctgttttgaaatacattccccaggaaattttcacgtttttccggctcagcacgtggagccataacaatgtcgccagcgacccgatcggcgtgattttcggcccgaggtcagaaccgataacattcgcgtaaatcaatgcttctctcagcagcccgtgagtgtccgttccgttgatggctatggcgtcaatcatcaccgtcggcaggttattcataacggaggagaggatcgcagcgataaaacccattccgagtgtgcccgcaaacaatccgtgatccgccgctttctgaataagctgagaaagaagatccgtcagtccggcattccgcaagccgtacacgacaacatacatgccgacagaaaaaaacacgatggcccacggggcgtccttgatgacttgtttcgcagggacggcggggcttcgctgcgccagaatgagaaaaatgaccgcgatggagccggcaacgaaggaaacgggtatcgacagcagttcgctgacgaaatatccgatcaataaaacggccagcacagcccacgataaccggaaaaggcgttcatccttaatcgcggatgccggatgtttcacaagaccggtgtcataccgtttcggaatgttttttctgaaatagagatacagcaccaaaatgcttgccgccagagaaaaaaggttgggcaccagcatgcgtgttgcatattcaatgtacccgatatgaaagtaatcagcggatacaatattgaccaaattgcttacaacgagcggaagcgaggtggtgtcggcgatgaatcccccggcgataataaacggaaaaaccagcttttcaggtaaattcaaagcccgcaccatcgccagtacgatcggcgtcaaaatgagcgccgctccgtcattggcaaacagggcggagacaacagcccctaagaccgacacatagagaaacatccgcagcccgctgcctttggccgccatggccatatgcagcgcggcccactcaaaaaaaccgatactgtcaagaattaatgaaatgataataatggcgataaaggcgagtgtcgcattccagacgatccccgtcacttccgcgatatcgtgcaggctgactgctccggcgatcaaagcgaggaccgctccgccgcaggcagaccagccgattgatatatgtttcggctgccatatgacaaacacaagtgtcagcacaaaaatcagcgctgataaaaccgcaactcccaagaatatatcccccttaccggcatgtaacagtgacttctttttgccgcaatgtctgtaaaacttcgtccttttcatctatctgctgcagaatcgagcaaaccagcgcgtattccggtccggacggatgaatggcatagtaccgccactggccctcgcgtctttcgcgcacaaggccggcgttctttaatttccgtaagtgctggctgatgccgggctgacttatatgaaaaatagccgtcagctcgcagacacaatattccttatcctccagaagcttcagcatcaaaagcctcgtcgggtcgcttagaagtttgaggcactggctgatcccttcggaacttaaagcattatgccgccgttccatgcgctcactccttttttacactattatataagcagacatttatataagtaaacggcaatataaaaaaagccggtcttgcactttttgcaaaaccggctcatgtttatttttggaacagttttttcgcttcatccattgctaatttatttcccagtgccgaataatcaagccaaggctgatcggcaattttatagacatggtttgctttcacggccttaagccctttccagacagcgcttttttgcaattctttataggcttgctgtgacttgtcgtctctgttaacgaccacgaaaatcgcatctgcgttgtaatcaggcagcacttcttgagaaatgacttcataagggcgggaggtattcatttctttaatgccgtcagccggtttcagcttcagatcgtcaaacagaatcggtcccatcgggcggcgtgtgctgaagacgcgaagctcttttgcgttcacgcggatcgccatgactttggcgtttttccctaattccttattcatcatggatctgacttgttttgtttcatcttcgtaatcttgaataaatgttttcgcttctttttcacggttgacgatttttccgatgtcttttaaatgatcacgccatgtgcctttatcaaggtcgaaaacgtgtgtgtttccgattttcttgtatttagacacatcttttcccgcaaattctttatcaagataaatgttgtctggattcagctcaagtaaagcttccatatccgggtctgaggcaggtccgagttttttcgtgtctttcagctgatttttcacatgagggagaaaatcttttaattctccgcccacgacggaaccggcaggtgtaacgccgagagccagcagatcatttgtcaggtgaatggacatcgaagcgattttatgatcgccggatttcttttttgactccggctgtgatgaatcggattggcaggcagccagtaagaaaatacacatgaaactgatgagcgcaattatttttttcatgggaatactccttgttttatgatttgattttcatgacgagatagagaaaatacggcgcgccgatggctgccgcaaccacgccggccggaatggcgttcggctgaaacaaagaccggccgatggtgtctgccgcgacaagaatgacaaggccgattaatccagcaatcggaataatatgctgatgcatggtgccgacgagccgtcttgccaagtgaggggcggcaaagccgataaagccgattccgccggccatcgcgacgctcgcgcaggacaagccgaccgctatggcgatcagcatgatcctttttctctgcacgtgtgcgccgagccccgccgctgcctggtcaccgagcattaaaatattcaaagaccgggcgttaagccatgcaagcggtgcgagaatgccgatccagggcaaaagcgaccacacgtgaatccaatctctgccccagacgtttcccaccagccagcgggaagcgaaggtataagtttcttcattcaggcgcagcgacataaacaatgtaacggcgctgaagcccgcggaaacggcgatcccgaccaacagcatgcggatcgttaaaaaaccgttcagcctgtcgtacgtaagcactacgatcagcagggcggcgagtgttccgcccgcaaacgtaaacagcgggatgaacatcgacgcctgcgcctccagggaatgaaagaatgtgatatacatcatcaaaccgaaggaagcgccggcatgcagtccgagaatgcccggatcggcaagcggatttcgggatacaccctgcaaaatagcgcctgacacgcctaagccgataccggccagcatcgtcaccagtatccgggggagccggtaatcgaataaaacggttgtgctttgaaacgtgccgtaaccgaacagcgtttttcccacggtgaggggagaaagccggaatgagcccgtgtgcagcccgatcagaataatgcaaacggcgatgaccagcagaacgagacctgccgccgccgctttttttgtttctttctgcactttcatttataagtctctcccttccttgcgggcaatataaagaaagaaagggacaccgacaagtgccaccatgatgcctatcgccaattctctcgggggactgaccgtgcgtgaggccaagtcggccaaaatcaaaagaatcgcgccgagcaacgcggacatcggaataatcagcctgtacgtaacgccgacgatcttgcgggcgatatgaggaatgaccagcccgacaaagccgatcgcgccggcagcggaaacagacacaccggcaagaacgacggcgatcattaatcccgcggcacgcgtcagagccgtgttcacccctaaattcgccgccacgtcatttcccattgagagaagggtgacggaccggcccatgaatgtcgcgagaatgatgaagaccgcaatcacgggaacaaggacttgtaaatgagcccacttgatccccgacaccccgccggcgtaccagaaggccaaatcctggcttaaatcgtaataaatcgctacaccggtactgagtgaatgtaaaagcgcggccacgaccgccccggcaagcgtcacctttaaaggtgtcatgctgccttttcccgccgcactgataaagaaaatcaagccggtgcttgccagtgctcccaaaaatgacatcatcatcagcagggcgtatgacaaatgagggaaaaaagcaaagctgagcgcaacaacaaacatggcgcccgcgtttacgcctaagacacccgaatcggcaagcggatttctcgtgacaccctgcatgagggcgccggctgcggcaaaagcggctcctgtaacggccgcgccgagcactctcggaagacgcaattcatgaatgatctgctggcccgttatgttcggattgtaatcagcaacagccgaccaaaccgtatgtaaagtaatgtctttcgcgccgaatgagacggcgaaaaaaatagaaacaagcagcccgatcaccgcgatcaggaagaaaaccccgttttttaagatgctgatcagacggcttgcggacgtgacagaatcgctcaaaaatcaattcacctacttttatgatcattgtccggcatttattgaatatgagaatcattttcatttgaaccatcatattataccgggccgattttcaaaacgcaatagagtgttcaacaatgatgcccttttttctttcatgtttatattgtaaaaaagaagtgaaaaacgtgaaagaggaaatcgctatattcagaaaggagggaggcaaatggcgggagaaggaaagcctttgccgattgaattttaccagagaccgtcagtggagcttgcccctttattgctcggctgtctccttgtgaaggagacggatgagggaacggcttcaggttatatcgtggaaacggaagcttatatgggagcggatgaccgggcggcgcacagtttcggcaaccggcgcacgaaacggacggaaattatgttccatgaggcgggccgcatttatacatacgtcatgcacactcatacattaatgaacgtcgtcgcctcggacatcggcattccgcaggccgtgttaatcagggcggcggagcctcatgaaggacagttcctgatggagagcaggagaccgggcagacccccgagagagtggacaaacggcccgggaaaactgacgaaggcgatgggcatttcaatgaacgactacggcggcatgatcacggaaccgccgctgtatattacggagggctttacgcctgaacatatatcaacaggcccgagaatcgggattgacaacagcggagaagcccgggattatccgtggcgctattgggtgacggggaaccggtatgtctcacgctgaccatgtttataaacgctgataacaggggaaagacaaggtaaaagaaaggggattcagacattgaaaaaatttttcaaaacgattatcaaatgggcgcccgtcatctatccgattatcagaaaaatcataaaagaacggaaggcatctaagcggaaccgcatgtccgcatcccgaacagccggctgatccggctgtttttttacggtcttggcatcggattgccgcattgacttgaaatcctccccagtatagaatttacatacatttaccccttcctcattctttttgcccatttttcacatctgcatctgatctgataggaggtttttctcatgcttcatgggcggcttcgtgaacttctgcgcttgcttttagctgctgaaacaccggttacaagctcagtcatcgctgcaaatgtaaaggtaacgacgcggacggtccgcaatgacataaaggaactgcaaaccattgtagaaaaacacggcgcatccattcaatctgtcagagggagcggctataagctgctgatccggaatgagcagccgtttaaaaactggcttcaggacaatttccagcagaacagcaccgtaccgatttttcccgatgaacggatagattacctgatgaaaagaatgcttctggccgacggctacctcaagctggatgacttggcggaagaactgttcatcagtaaatccacacttcaatctgatttaaaagaagtcaaaaaacggctccgcccctatgacatcattttggaaacaaggccgaactacggctttaagctgcgcggcgaagagctccgcctccgttattgtatggcggaatacttagtggacgaccgcgagcccgagcctgatctcctgagtgaaaaggccggtattctgccgaaagacgacattcatgtgatccgcacagccattatgaagcaggttcgaaaccataagatcccgctttctttcttcggcctgaacaatctcatcatccatatcgccattgcctgcaaacgaatccggacagaaaactatgtatctctcattccggaagatcttcatgatattaagctcgaaacagaatatcagtcagcggaagccatcgtaaaagagcttgaatctgcgctttcggtcacctttcccgaacaggaaaccgcctatatcgccattcacctgctcgggacaaagcgcatgacccagtcacaaatggaaggaaaagagcttacaaggctgatagacggggaaaccagccgtttgacggaggccatgattgaagccattgagcgggagctgaagctcggaatcacggacgacaatgagctgaaagcgggtcttgcgctccatatcaagccggcgattaaccgaaaccggtacggaatgaacctgagaaacccgatgctctccgccataaaggagaattatccgctcgcatttgaagcgggagtgattgcgggaatcgtgatcaaggagcaaaccggcattgatattcatgaaaatgagatcgggtatttggcgcttcatttcggagccgctattgaaaggagaaagacggaacggccgcctaaacgctgtctgattgtctgtgcgtccggcgccggcagcgcgcagcttttaagagaaaagctccgttcccggttcgcaaaacgtcttgaaatcgtcggaacggctgattactgcagccttgaccagctttcctttgagtcgattgattttgtggtcagcacagtgccgatcaaaaaagacctgcccgttcccgtattgaaggttcatacgctgctgggcggcggggattttacaaaaatcgacgccatgctggaagaaaatcgggaacaattgaactttctgaaaccggagctggtatttttgcagcaggatctggagacgaaggaggacgtcatccgttttctcggacagcaggttgcagaagccggcctcgcttctgattctctgaccgattctatttttgaaagggaagcgatttctcctacgagtttcggcaatcttacggcgattccgcacccgctcgttccgcagacagacacgacgttttgggcggtatgcacgctgaagaagccgattgactgggcggataagcgtgtccaatttgtctgcctgctctgcgtcgagaaagaaagcaaagccgacctccagcatatgtacaaatggctcggcggcatgttggatgatccggccgcggtaagccgtctcttaaaatgcacaacctatcaggaggttttacgagtattcagagacaaacgatcagagaaagaccgggatacaccttttttccgttagcagcggaaaaagcctgagtagttatgaaagcgatttcataatatgatgttactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttgggcctcaagtccgttatttgcttccgcagctgaaaaaattgggtgaatcaaaaggagtgccggttgaagtcatcaataccgtccattacggcacttgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcactgcgtgacggaatcatcctcaccatgccgcttatcatcatcggttcattttttctgatcatcggcaacctgccgattccgggatatgcggatttcatggcgaagacgttcggaagcgcctggtctcaaaaactgcaatatccggttgatgcgacctttgaaatcatgggccttgtcgccgctttcggaatcgcctaccgcctggctgaaaaatacggggtggacgcattatcggccggtgcgatatctttggcggcgtttctcttggcaacgccgtacaaagttccgtttctgccttccggcgcaaaagaggaaatcatggtgggcggcggcatcccgctgtctctcatgggaagcaaagggctgtttgtcgcgatgatcatcgccatgctgtcgacggaaatttaccgcctgatcatccagcggaatttcgtcttcaaaatgccggacggcgtgcctccggcggtcagcaaatcatttgtcgctttaattcccggctttgccgtcatctttctgatctggggtgcgcgtttaattgtcgaagcgacgccgtttgaaagccttcataacattgtaagcgttgtactggggacgccgctctcgattcttgggggaagtctcggcggaagcctggtagccgaagcggttcaaatgcttttgtgggcgtgcggattacatggggcgaacattgtcggcggcgtcatggcgccgatctggttcggagcgatggatgccaaccgtgttgcgtttcaggcaggcgatgcgctgccgaatattttcacccagcagttctttgaaatctggatcaacatcggcggaagcggcgcgacactggcgctcgtggtcaccatgtttctccgttcgcgaagcaagcagatgaagcagcttgggaaactcgccatcgggccggctgtctttaatattaatgagccgattattttcggaatgccgatcgtcatgaacccgatgcttctcattccgttcatcatcacaccgcttgtcacactggtctttacctatatcggcatgagcacaggcctcgtcgccaaacctgccggcattgccgtcccatggacgatgccgccgattttctccggctatcttgccacgggcggaaaaatatcaggggctgtcatgcaggcgattaatatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggcagaagcgcatcaatggaagccattgccgccgcaaagcagggggacagagccatggccgaggaaaagcttcaggaagccgcaagggaactgaccgaagcccatcattaccagacagaattgatccaaaatgaagccggcggagaaaaaacagacatgacgcttttaatggtgcatgcgcaggatcatttaatgaatgccatgaccgtgaaagacttggccgctgagttagtcgagatttacgaaaaagtgagtctgcaagggggagcaaaaatatgacaaaaagaattaaaattgtaacgatcggcggaggttcaagctatacaccggagcttgtggaaggcatcattaagcgctatgaggaactgcctgtcagagaattatggctcgtcgacattcccgaaggcgagaaaaaactcaatatcgtcggcacgcttgcaaaacgcatggtcgaaaaagcgggtgttccgatagagattcacctgacgcttgaccggagagaagccttgaaggatgcggatttcgtaacgactcaattccgcgtcggtctccttgaggcccgcgccaaagacgaacggattccgttaaaatacggcgtaatcggccaggagacaaacggtccgggcggtttattcaaagggctgcgcaccatcccggttattctggaaatcgcgaaagacatcgaagagctttgtccgaatgcgtggcttgtgaatttcacaaaccctgccggcatggttaccgaggccttgctccgctactcgaatctcacaaaagtcgtcggcctctgcaatgtgccgatcggcattaaaatgggcgtcgcaaaagcattggatgtggatgtcagccggatcgaagtgcaatttgccggactgaatcacatggtcttcgggttagatgttttcttagacggcgtcagcgtgaaggatcaagtcatcgaagcgatgggagacccggaaaacgccatgacgatgaaaaacatttccggagcggaatgggagcctgaattcctgaaggcgctcgatctgattccttgcggctaccaccgctattatttcaaaacgaaagaaatgctcgagcatgaaatagaagcttcacagacggagggcacacgcgccgaggtcgtgcagaaggttgagaaagaactgttcgaactgtacaaagatccgaatctcgccatcaaaccgccgcagctggaaaaacggggcggagcgtactacagtgacgcggcctgcaacctgatcagctccatctataacgacaaacatgatatccagcccgtcaatacgataaacaacggcgcgatcgccagcattccgaatgactcagcggtcgaagtgaactgcgtcatgacgaaagacggtccgaaaccgatcgccgtcggtgatctgccggtgtctgtccgcggactcgtccagcaaatcaaatcatttgagcgcgtcgccgctgaagcagccgtcacgggagattatcaaacggcgcttcttgcgatgacgatcaaccctcttgtcccgtcagactccgtggcaaaggccattctggatgaaatgcttgaggcccacaaagaacatctgccccatttctttaagtcgattgaagcataagagcagtaaaaaaacccggattcgcttccgggttttttgcttattttgattcgcttagtgaggcgactttcgccgtccagccgaacacgtcggcttccgcgcctttttgaatgcctgtaatggtatcatacaatttcttcgagatctctccggtttcaccgctgccgatgacaagactttcatcattccagatcagttcgccgaccggagaaatgaccgccgccgtaccggttccgaatgtttcttccaatcggccgtcacgatgcgcctggatgatttcatcgatcgaaatcttccgctcagacacagtcagtccccaatgtttgagaagggtgatgacggaatttctcgtaatcccttcaagaatgcttccgttcagctccggcgtcacgatttcgccgctgattttgaagaagatgttcatgctgccgacttcttcgatgtatttcttctcaatgccgtcaagccataaaacctgggaaaatcccttctcttccgcaacctgctgcgctttcaggcttgatgcgtagttgccggcggttttcgcgtttccggtgccgcctttgacggcgcgcacgaattcgttttccacggcgatttttaccggtttaatgccttctttgtaataagagccgaccggggaaaggatgataaacagcttgtacgtatgggatgccgctacaccgaggaaaggctcggtcgcaataataaacggacggatataaagggaagtgccttccgctttcggaatccagtcttggtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccatccttgatcggcgtcgtaatccataacaaacatatggtcggtgaaaattctgccgaacgcaaggttatgggggtccggtttcggttttttggctgaagtcaattcaacacgaatgtcttgtttcataatgttctgtctccctattggtgttattgtcaaacttatttgaaaataatttatattctattgtataccttcaacaaatattcgcaatagttttcctcaaatttgtgaaaaaatcaaatcacataaaaagcaggggagagaatgccccctgcgtgttcgtttttacatattctgtaatcatcgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataactacgaacatcggttcagcgccggcatctttcagaatgtccagcatatcctcaaagtcgtgatattcgactgatttggcgtacgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttggtttctcccattgaataataaagatcttttttctcaagcagagaataataagctttggcagccggcatgaccgctttcactttccatgattgtccgttgaccattcccttgtataattcagaaaggacggcatcatgctgaacaactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagctttttgcccttcagctgctgataatgcgccgcaaagttcacggcgtgtatcaaggattggtccccgccttttccgacaagataaggcgtaaagccttggttgttcacttggaaatagttggacgggtgaaactcatccagtcttgaaagctcggaagaaccgaaaatcggcatatacttcgagtcttcgaacattttgttttgcagatagaggccctggaacatattcggatttaaggccgctgccgactcttcgacacgtttttcaggaatgaagcgcgtaagccatgaagccggaactgcgatagctccgacaaacaggacaaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagttctacagttccgaaagaatcaagcagtccttcttcaaagatttcaatatcaggattttctttcacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtaaaggccgtatataatatattgcagggcgagtccgtgccagacgcccatcagcatgaacagcaggaaatacccgatgttcgagacggccatccggttctttatccattttttctttgtcatccagaatacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttactgtgggtgatatgaggcagattcataatgaaatacgtgttaatcgcatatccgataatgaatttgtacaagaaaccgataaaaattttatgaatgccggtatacagtaaatcagcgtattctccctttgtccatactttctgttcgtccttggcaaatctgcggtatctgtcgatcggaccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccggatgatgaggcgccggcgggaagaaaaacggccataatttagataaaaacaggggtaaaatggacgcgatcacggccatactgaagacaaagccgctgttggctttcagtctgtaagcgagataacccctgattaaaagcacctgccacagcgtaaagatacatagtgcgatcacgccgtgcagatcatgcgcgaaaatcaaagccaatacgatgatggatataaacatgttgtatccttggaatctcttgccgttcagccctaaaataatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttcttttttaatggcgcttgtcagctggaattctttttcaaaatcatgtttttcaggcacgatggcggcaattaaatattcgactggtccgttaggctgatacgggatgacaaccgccgtctgcacatattgagactgccttacatgtacttcgatttcctccagctccatgcggtagccgtgaagcttaatctggaaatcaaggcgtccttggcagaaaatctgaccatcctgaacataaccggcatcacccgtgtgatatgcccactggccgtcaattgagaaaaacgctttttccgtcagagacggttcaccgagatagcctttgctcacgctcggcccggcgatgatgatttcccctttttctccgtccggaagcttattcccgttttcatccatgatgaagatattcatatcgggttttgcaaaaccgacgggcagagattcattttcatcgataatctgctgcgtaatttcaacggaggtgacggcaaccgttgtttcagtcgggccgtatgtattgaatacgcgggccttcggaaaacggtttaacagttcctgtgccacggcagccggaagcgcttctccgcaaaacataaatacttctgcctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcagtgcagcgtacctcccgtttgaagcgacgggaaaatgtccatgacagataaatcaaaagaaaacggagcttggtttaagaatgtcttacccccgcccacaggaaaatccctgcagatccagtcagtgaagctttgcaggttatcagccgatatctgcacgcccttcggatttcccgtgctgccggacgtgtaaataatgtaaaacgtatccagctcttttacccagttctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcccaagaaagaaacaatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcgtatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcatcatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaggcgctgttcaggcgggatttttaacttatcgtaaatataaacgaggtaaaaaaattttggcggctttttcttaagcaggcttgtgccgaaccccaagggagaagggcgaaaagccgtttccggcaggatagctgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagatacggaggattccgtcggtatcggcggagcgatcgtccgccacggcatgaagccgaaaacaattctgcagctggcgctcggctcttatgcgattgctctcgtgctcggtgtttatatctgcatgagcagcagctggtggcttgcggctatcggccttgccggcatgctgatcggctatctgtatacgggcggcccgctgccgattgcgtatacaccgttcggggaactgttctccggcatttgcatgggctctgtatttgtccttatttcttttttcattcagacaggcagaattaatgaacagagcattttgatttccatcccgatcgccatcctggtcggagcgattaacctgtccaacaatattcgtgatattgaggaagataaaaaaggcggacgtaaaacgctggccattttgatggggcatagaggggccgttatgatactggcggcatcttttgccatcgcttacatctggatcgtcggtcttgtcatcatgggttacacaagcccgtggctgttcctggtctttttgagcgtgccgaaacccgttcaggccgtgaaaggctttgtgaaaaacgaaatgccgatgaacatgattattgcgatgaaatcaacggcgcaaaccaatacattcttcggattcctgctttcaatcggactcctgatcagttatttccgctgatcaaatgaaagggcaaatgctataaccggcatttgcttttttttatgacataatcttcacgatattgtaaagaacctgaccgcggactgacccgtctcatatatggacagcaaagcaaggagatgaaaaaaatggacttgtcaacagcccatatggatgatttaaaaacggtcatggaagattggaaaaatgaattattagtttataaattcgctttagatgagctggatacgaagttttctatcatcagccaggaatataatctgattcacgggcataacccgatcgagcatacaaaatcacgcgtgaaaagttttgaaagcatcgtcaataaactgatgcgcaaaggctgcgatgtgacgacgcaggaaatgaaagagcatattcatgatatcgcgggtgtcaggattatctgttcctttatttccgatatttataatgtcgctgaggttctgaagcagcataaggacctgaagatcgtaaaggtgaaggattatatcaaacatccgaagccgaacggctaccgcagcctgcatttgattattgaaattcccgtttatttgacgaatcgtgtggaatatgtgaaggcggaaattcaaatccgcaccatcgccatggatttttgggcgagccttgaacacaaaatttattacaaattaaataacgaagtcccaaagcatctgaccgacgagctgaaggaagcggcggacatcgcccattatttagacgaaaagatgcttgggattaagaaagaagtcgattaaacgattgacccgtcacaaccagccggaccgctattatacgcagtccggctggttgtttatccgtttatgcgcagctgtacaaattttcgcctgcccacctgaatcgtcatgccgtcttctgcggtaatgacggtatgaagggcatccgttttctccccgttcactttgattccgccgttttgaatcatacggcgtgcttcgctttttgaagaaaagagtccaagcgtgacaagcagctcaataaggggcacggtcttttctccgtcccatatgacggttttcatatcttcaggcaggctgttttgctggaagacacgtttgaaatgccgctctgccgcatccgccgctttcgtgccgtggtacattctgacgattgtacccgctaagatcattttggcatctctcggatgaagctttcctgattccaaatccttctccatctgttttttctccgcaggctctaagtctgtcgctaaatggatatatgttttcatcaggctgtccggcaatgacatcgttttgccgtacatgtcgttcggatgctcgtcaatgccgatatagttgttttttgatttagacattttttcaacgccgtcaagaccttccaaaagcggcatgaggatgacgacctgcttttcttttttgtagcgttcttggaaatggcggcccatcagcacgttaaaatgctggtccgtaccgccgagttcgatatcgctttcgagaacgacagaatcgtaaccctgcatcagcgggtaaaagaattcgtgaagtgagatcggtttttgcatggcgatgcgctcctcaaagtcgtcgcgctccatcaggcgggcgacagtaattttccccgctaattcaatcacatcttccagattcaatgtcttcagccattttgagttgcagtgaagttcaactttgtcttgatccagcaccttgccaaactgttcaaaataggttttggcattgtgttggacttcttcatcagtcagctgttttctggcttgcgacttccccgtcggatcaccgatttttccggtaaagtccccgataacaagctgtatgatatggccgttttcttgaaattggcgcagtttgtttaacacgacggtatggcccaagtggacgtcgggtgcggacggatcaaggccgagtttaatgttcagcggcttgccggatgccactgatttggcgattttatttctcaattcttcaggcggtatgacgtccgcggcgccggtcatgtacaaatccagctgcctttgcacttctttttcctgatcattcgttaaagtgattgattccatcttttacatcctcctttttttagccaaacaaaaaagccgcatcccaaaaagggacgtggctgtatgcacgcggtaccaccctgattgaagacgaaacgacgtcttccgctcattcgaataacggtttcccgttctttgctactgaagttcacaaagaaagctcagggaggtaattcacgtttgtctttgtgccggcttgcaccatccgccggctctctgaaacagggagacaatccgttactgattcccgtcatagctgctatgttatgaaattgtcagcgattttttgcagcagggcggacagcgttttttgttcctgtttatccagacaggccgtcagttcaatttccccctgatgaaagtcggggtacagatcttcaataacctttctgccctcatcggtaatactgacgaatacaagcctgcggtctcttttgttcgtttgtctgctgcataagcccttcttttccaaagtgttcaggacattgctcgccgtcgccgaggtaattccggatagagcggctatccttcttgtatcaagcgtttcccattcacaaaggtcatacaggatggaaaacgccgtccatgataatttgtgtgccgacagcacctctttctccatttttacacggagctgctgggcggaccgatagagtgcagctgcaatataggccgcctctttgtttcggccggatagatcggaaaaaggcctgttcggcttcttattgtctgatccggcatcgttgcgaatcgtcaatggcgtcatgctccttattattgtcagaatcattagctatgaaatgaattttaacagagaatgcgaaagatatcaaatcgcaaacagcacattcccgcagaaaaaatgtgtaagattgaggtttactttttaaaaaaagggaaagacatttgtacaacaaaaagggagatgaatatcagtgggaaagaatgaaacaatgcatatcgtatcatgtgccgatgataattatgctcgtcatttgggtgggatgttcgcttctttattgatgaatatggataaaacaaggaatgccaaattatatgtgatcgacggcggaattactgccgaaaacaaggacaagcttgaacagactgcgatgtcattcgggacgccgcttgaatttttagaagtagacgctgatcaatacaagcatgcagtcgaaagcagccatattacaaaagcggcttattaccgcatttctatccctgatttaattaaggatgagtccgtaaagcggatgatttacatcgattgcgatgcaattgtgatggaagatatttcggttttatgggacttggatatttccccggcaatagttgcggcggtagaagatgccggacagcatgaaagactgaaaaaaatgaatatcagcgacactgccaagtattttaattccggtattatgattatagatttcgaaccttggagaaaacagaatatttccaaaaaagtgattgattttatcaatgataacagctcggaggattttctcgtgtttcatgatcaggacgcgcttaacgcgatcttatatgatcaatggcatgaactgcatccgcgctggaacgcgcagacgcatattatcatgaatgagaaaacgcctcctgaactgatcgaccgtatacgttacagagaaacacgtgccgaaccggccatcgtccatttctgcggcggggacaagccttggaatacaggcacctcgcacccgtatcgtgatcattatttccgatatatgtcctttacgaaatggaacacgattgaccgcccggccatgaaccaataggcaggtgtgatgaaaacgcttgtgaagccgttgaccggctcacaagcgttttttttattatttcacccgaatcgcacgcacgcgtttttgcaggctggtcttttcggcagacggcttcaatcggctgactgccgtttgcgccgctgattttgcttttttcgtcttggttttttccgccgtttttactttgtcccttgcctgctgccggttgagtttatcttttatccagccaagccgtttttccagaacggttttttcttttcccggctggatttcgctgactgctttttgggcttttgcggtgttggcctcagaagtctttttttccgcctgcttgacgctggcctcagcagttctcaaaaggcttgagttgacagcgttcagccgcttttgcagcccttttttctctgaaccggccggtaatttgcggatggcgctttgtgcggcattgacggcggtttttttcttttgtttttcggcagtccggactttgtctcttgcgtccgtcacatttcttgccgtctgaactttattgatccgcgcctcgagagcggtttttccttttgacttggacagtttgctgactgccgtttttgcttcatcgatatctgcctgctttttcgtcttttccgcttttattacggcccgttcggcaaagctcttttgttttgtgtgatattgcgccagtccgtagccgaatcggctgtcacgtccgggagcgcccagatctttgacgttctgctgcatctgctgccggagctgtgtatttgtttcctccggatatttctgcctgagcagcgcgaacatgccggtgacgtgcggcgcggcttgagatgtgccgtcagctgtggcgtacatttgattcagatacgtgctcgtaatattagtgccgggtgcggcaaactcaatttgttttccggtcgtggaaaaagctgcgagcccgtttttttcagttgacgctgagactgccgttacgctgctgtaggcgcccggataattgacgggttttttattgccgtcgtttcctgcggcggcaacgatcacgattccttttttgtaagctttgtcaacggcgtcgtgaagacttttgctgtctgcgtttgtcccgaggctcatattgatgatgtccattttattggcgatcgaccagtcgatcgctttaagaaggcttttgagatctcccgctccttttctgtctaatgctttaaccgcatataaccggacatccggcgcgatgccgtcgatgccgtatccgtcatgtttggccgcaatgattccggcgacatgcgtcccgtgtccgttgtcatctttgtatgagggagtatagctgactgcggaatagcctccggcaatggagagatcatcatgagggtaaatgccgctgtcaatgacagccactttcaccttttttcccgtcaagccttctttccacgcctgcttaacctgagtcggttcgatatcccattgcggcagcacgtaactgctgctttgggcagctgataacgggcggatatcagaaccgcctgctgcctgaaaggatacattctcttctacatataagatgtcagggtcctgtttcaggtctttcactgtttgcgaatcggctgacacggcgactgccgggagatgctgataggtctgttccacatccgctccgctgtctatggcggattccttgccgttttgatttttgtacaccacgataacgtcccggtcatgcgtctcggcgtgcgcgggcgccgcggcggagaacaggctgatgcacaaggccgcggccattatcggtttcagggtgtgatacattgcgattccccctttttctttatatatcggcagtgcggaattctttttttcctgaggggtaaggaaaatttctgtatgcaaatgtaagcgtttccaaaatatgatggagaaaatgctttaagacatctgcgcaatgaactcaaaaagggggtttttgataaatgagtacgttcaatcgggtcatggaagaaaaaatcatgcctgtcgccggaaaagtcgccggccaaaggcacttaagagctttgcgggacggcattattttgactatgccgcttatcatcatcggatcggtttttctgattctgacgagtcttccgattcccggttatgccgattttatggctggtcttttcggtgaaaattgggttgaaaagctcgggtatcccgtgaatgcgtcctttgacattatggcgcttgtcgccgcctttgggattgcttaccggcttgcggaaagctatgaggtggatgccctgtcgtcgggagccattgcccttgccgcctttttattggcgacgccgtatcagattccgtttatccctgacggctcgtcaacagagattatggtgggaggcggcataccgatttcgctgctcggaagcaaaggtctgtttgtcgcgatgatcattgcaatgctgtctacggaagtgtaccggtttattatacaaagaaatatcgtcattaagatgcctgacggagtgccgcctgcggtcagcaaatcgttcgttgcgctcatccccggtttcattattattacgcttgtatggctggcccgtctgtttattgaaataactccttttaaaagtctccacaatgtcgtaggcgatctgctgggcaccccgctgtctattttgggcgggagtctcggcggaagtcttatcgccgaattcgtgcaaatgctgctttggtcgtgcggcatacacggcgcgtccataatcggcggcgtcatgtcgccgatctggtacggggcgatggacgccaaccgtttggcttttcaggcgggagaagcgctgccgagcatttttacgacacagttctttcaaatatggattaatgtcggcggaagcggagcgacgcttgcccttgtgctgaccatgcttgtgcgctccagaagcaaacagatgaaacagctcggccgtctcggcatcgggcccgcgatttttaacattaacgaaccgattattttcgggatgccgctcgtcatgaatccgctgttaatcgtgccttttattgttgcgccgctcttgaccattacggcgacgtacatcgggatgagcacggggatggtggcaaaaccggcgggaatcgccgtgccgtggacgatgccgccgctgatttccggttatttggcgacgggcggaaaaatctccggttcggtcatgcagctgatcaatctcctgattacatttatcatttattatccgtttttccgaatttgggatcttcaaaaatggagagaggaacgggcggcggaacaaaacgtcacagaagaaacataaaaaaaaacgggcgctttcgcccgtttttttaacgctggaaaaattcgatccattcgccgtcaggtccttcaatgtaaaagtagcggtacccgttcggaagtgtcgtgatttcttcatcaatgaatacggcgccctgacgcttcgcatgcgtgaactccgctgcgatatcttcagtcaataaagcgacatggtgcacttttccttctgcgggaagctcgctgctgtagccctggatcagctcaatttctgtctccggcccttcttgaaagccgagaaaggcaagttcaataatgccgttcgtatgagtgatacgatcctttaactgcataccgagaacgtcttggtaaaaggcgatggatgtttcaatatctttgaccataatgcctgtatggtcgattcttttggctgtcatggttttccccctgttttgaatttttcgggacaatgcggtgttgatcatgttttatggtacgataagagaaagcaaaacgaaagaggaatgcacaatgaagctacttacagtgaaagatacatttgccggaaagctgaaaaaaggattccccctgattgaaaaagacgctctgtccggaagctcggctcatttaacagagggcgatctttttgatgtgacatccgagaagggtgagtttatcggaaaaggctattacggtttgcagaataaaggagtcggctgggtgctgtcccgcgcgagagatgaacggatcgacggacgtttctttctggacaagctgaaaaaagcggctgaagcaagagcccatctgtttaacgcgcccgatacgacggcgttccggcttttcaacggtgagggcgacggcatcggcggcgtcacgattgacttttatgacggttatctgctgattcaatggtacagtaaaggcatttacgcttataaggacagcatgattgaggcgattgacggactggagctttcttataaagcgatctatgaaaagaaacgattcgatactgccgggcaatacgtggaagacgacgattttgtcaaaggcgaaagaggagattttccggtcattgttcaagaaaacggcatacggtacgcggcggatttaaacgatggggcgatgacgggcattttcttagaccagcgtcatgtacgcaaagcgattcgggacaagtatgcaaacggcagacgggtgctgaatacgttctcttatacgggggcattttccgttgcggcggcgcttggcggagctgagaaaacgacaagcgtcgatgtcgccaaccgcagtctcgcaaaaacgattgaacagttcagcgccaacggaattgattatgaggcgcatgacattaaggtcatggatgttttcaaatacttcggctatgcggagaaaaaagggctggcgtttgacctcatcatccttgatccgccttctttcgcccgcacaaaaaaacggacgttcagcgcggcgaaagattataaaaacctgctgaaggaaacgatcgccatcaccgcaaaaaacggcatcatcgtcgcttcgacaaacagcagcgccttcaatatgaagaaatttaaaggttttatagagaccgcctttaaagaaacaaatgagcgttacgacattttggaagaatacacgcttccggaagatttcaaaacgattccggcgtttaaagaagggaactatttgaaggttgttttcttgcggaaaaaataggatgatcatttatagcgtggaaagagggggaaaagaaaaccctcttccatcgctttaatacgggataaataatcttcatatcttactgtttaaagaaaaaacccgctattatttagtatctcatctgtgccaagtaaagtggcctcactaatccctccgcccaattgtatcctcgataatgattttaatgggcaccaccctttttttgagtatctatataaattgtaatggcatcactcatgagcttcgccaacccttcaccataccggtcgatgttcttagtgaagcgttcatcttcaatatagagttgacctaatccgtaaaaggcatcaaaagaatattcaccaaaattttcattgagaaaatcaaaccactctttgatagctgtttgtacgtctggggactcgggagattggttaataaggagtgcaaatttattgaacattgcagtccacttatcagataaatctttttgctcaccatcagtcatgtttttcaatctaatatttaccttatcgacaggttgatcaccccaccgtttgcgggcttcttgctcataaagattatcattaaagttaattccctcaaaccgctctttgttcgtcatgcaaatctctcccatcatatgtttgattgatttatcgatggtttcaatcatcttattgactctattccgtttctcaatcaacattttcttttgtaaaatgaatgcttcccttcggttaaatgaaggattagtaatgatttctttaatctcttttaaggagaaatcgagctccttgaaaaatagtatctgctgcagctgttcaagattctcttcagaataaagccgataaccggaatcggtcgtttcctgaggagtcaataatccaatttgatcgtaatgatggagagtgcgtatgcttactccaatcaggtcagctacttcttttactttcatacccattacgtttgccgcctccttaatggctactctaaagtattacgcaacgtaagagtcaatagttggttaaaaattttttgtatataaagggagaacatatgaggatttcattgctgaaattaaagaaaaaaaagccgggcgtgaagctccggcttttttctattcaataatgtgctgcacccggccgattcgcccgtcttcaaggcggaccttaatgccgcgcgggtggaagcttgagttcgtcaaaatatccttcacgattcctcttgtcagctttcctgaacgctgatcggctttcaggacgatatcgacttcaagtccttttctgatgctgcttcgctgctggccgttcatatgacacatccgttcttcagtcttttcacttcatgtcttatcatatcgtgttttcgtctttttatgaaggacagacaaatcaattcttcatggcaactaaaaaaagaccgctctgtaaggagcagtcttttatgacataaacgaaagcaaaatcggggccgcgcacagtgtcataatcgcggcgagaatcatggacacgcttgagatcgttcctgatacggagctgagctcaaatgctttagatgttcccgctccgtgcgcgctagttccgagcagcacgccccgggcaatttcgttatcaatgcggaaatagcggatgaccatcggcccgatgatcgttcccaataaagccgttaaaatgacgaaaaccgctgtaacggccggcatcccgccgatcatttctgaaacgttcatggcaatcggcgtcgtcacggatcgcggcacgagactgtcgactaagctgctgccgagattgaaccattttgcgataaaggctgttgacagaatggcgatacatgaaccgaccgctacgttcaaaataatttccacggcgtatttctttaaaatcgggaaatatttataaagcgggatggcgaacgccactgttgccggctgaagcatatcggtcagcagtccgccgccgagattgtatgtctgatacgggacattgacaagaagcagcagtacgaccaaaacagcgggcgtaatcagaagcggcgacgtatacacccgcggaaaacgaatgtagagttttttcgcgcccaaatatactaagacagttaagaataaacttatgattccgatgaacacgtttgttttttctcctttctttttgctatcagctgtgtaagcgtacctgttgaaaccatcacgacaaatgtgctgatgacgacgacaagtaaaatgcttacgccgaatttagacataatatctccgtattcaatcactccgacggcagacgggatgaaaaacagcagcagctcaccgaggagccatgctgcgccaagctcaatccattcaagtttgataatcttgaaatgcaataatgtgaaaagaatcacaatcccgattatactgccgggaatatttatatgaagagccgccgtgatccaattgatcagacgcgcaaatataaacagcagagcgatttgaataacggtaagcagcaattttttcataatgatgcctcccttatatttatattgtacagaaggttttgctataggtaaaatacatataaagaataatgtgtattccttttgtctatagaaaggatgaaatgtaatggatatccggcacttaacgtatttcttggaagtggcccgtttgaaaagctttacgaaggcttcacagtctctgtatgtttcacagccgacaatctcaaaaatgattaaaaacctggagacggagctcggcattaaactgttttaccgcaatggccggcaagttgaactgactgacgccggacagagcatgtatgtgcaggcgcaggaaatcacaaagtcattccaaaacctgacgtcagagctgaacgatattatggaagtgaagaaagggcacgtccgcatcggtcttccgccgatgatcgggtccggctttttcccgagagtgctcggtgacttccgcgtcacataccccgatgtgacgtttcagcttgttgaggacggctctattaaagtgcagcaaggggtggaggacggctcgcttgatatcggggtcgtcgtgcttcccgcgaatgaagagatttttcataccttcacaatcgtcaaggaaacccttatgcttgtcgtccatccgtcacatcggctcgctgacgagaaagaatgcagtcttcatgaattgaaagaagagccgttcatatttttcagggaggattttgtccttcataatcgaattatgacggaatgcgtgaaagccggattcaggccgcatgtcatttatgaaacatcacagtgggactttatcagcgaaatggtatccgccaatctcggtatcggcctgctgccggaaagaatctgtcgcggtcttgatcctgacaaagtcagaaccattccgctcgttcatccggtcattccgtggcatttagccatcatttggcggaaggaccgctatatgtcctttgccgccagagcctggctggagcatacgaaatcgtatttatggaatccgaaaaagagaaaaaaggatgattaagcatggacgcacaaaccgcagctcaacacttgagtaaagtgcgggatcaaaacccgctcgttcacagtatcaccaataatgtcgtcacgaacttcaccgctaacggactgctcgcgctcggcgcatcgcccgttatggcttatgcaattgaggaggccgccgacatggcgaaaatcgccggagcgctcgtcctgaacataggcaccctcagctcggcatcggttgaagctatgatcgcagccggaaaatcggccaatgaaaacggtgttccggtcatttttgatccggtaggcgccggcgccacgccgtttcggacggcatcagcccgcaagatcatacaggaggtccgcttgtccgttattcgcggaaatgccgcggaaattgccaatattgccggcgcccctgattggaagataaaaggcgtggatgcgggggaagccggaggagatgtggttcagctcgctaagacggctgcaagcgggctgaagacggtcattgcgattaccggaaaaaccgacgtcatctccgacggcaccgacacatacgccgtacaaaacggtgataaactgctgacgaaggtgacgggggcgggatgcctgctgacgtctgtaatcggagccttctgcgcagcggggcaggacgttctgcaagcggccgtttcagccgtttctgtatacggaagcgccgctcagcttgccgctttggacacctcccataaggggccgggcagcttccagattgagcttttaaacaagctggcaagcatctcagaacaagaagcggctgagcttgccgcaattgaaagggtgatagaaaaatgacgcgtatttctcgggaaatgatgaagaatatgttatcggtttattttattatgggatcaaacaatacaagcgcagacccggtttccgtggtgaaaaaagcaattgagggcggcgctacgctttttcaatttcgggaaaaggggagcggttctttaacaggggatgaacgtgtcctgttcgcgaagcgggtgcaggatgtctgcaggcaggccgggattcctttcatcattaatgatgatgccgaattggccttgcgccttgaggcggacggagtgcatatcggacaggatgacgcagacgccgaagaaacgagagcggcaatcggcgatatgattctcggtgtgtcagcacataacgtctccgaggtgaagcgggcggaagaagccggagccgattacgtcggaatgggcccggtctatccgaccgaaacaaaaaaagatgctgaagccgtgcagggagttacattgattgaagaggtacggcgtcagggcatcaccattccgattgtaggaatcggcggcattacggctgacaacgcggcgcccgtcattgaagcgggtgcagacggcgtcagcatgatcagtgccatcagccaagccgaagatccaaaagcggcggcgcggaagttttcagaggaaattcggcgctccaaagcagggctgtcccgatagggcggccctttttctgtgtgcgcaaaaaggcgtgacggactgggagaatagaagccgtatgtcaagaacagagcaatcaagcttgcaatatcgaccgaagcgtttgacggctctatcgcttctctcaaagtgacgcctgaaccaatcagcgcaggctcaaaagccctctataaaacagtgaatagcgcgaagtgagagaccatttcgaggtcacggaaaaacttaatgcggaattcagcgaatttgaagttttgatgtcgaaatacaaaacgtgcgatcaatgtatacgtcttgtgatacattaagtacagatcaaatcagagagataagcacgaagctgacggccctttctgaaaccatgtcgaagattgccgatgtgctttaaaaggagttaagacacagcatgagcgatgaacataacaaggaaaaacagatccacagacgggatgtcctgaagtggggcgccgtcgcgggcgcagccgtcgctgtcggagcgagcggcctcggaggactcgcgccgctcttcaaaccggcggccaccgcttcaaagaagaatgatgaaaaacgtgatcgtgatcaaatcgttcctttttacggaaagcaccaagcaggaatcacaacggcgcatcagacgtatgtgtattttgcggcgcttgatgtcatgtcaagcgacaaagccgatgtcatctcccttttcaaacaatggacaagcttgacgcagctgctgacttcaggcgccgtcccgtcaggcgaacagaaaaataaatatatgcctccgcaggataccggggagtcgcaggatctggcaccggcgaatttgaccgttaccttcggcttcggccccgggtttttcgagaaagacgggaaggaccgcttcggactgaaagataaaaaaccgaagcacctcgccgatattccgccgatgcctaacgacaagctcgataagaaacaaggcggcggtgatatcgtcatacaggtctgcgcggataatgaacaaacggcgtttcacgcggtgcgcaacctgatgaaacaggcatcgggtgtgtgtgaagtccgctttctcaataaaggtttcttaagcggcggaaaaaacggagaaacaccgcgcaacctcttcggattcaaagacggcaccggcaaccaaagcacgaaggatgaaaacctgatgaattcgatcgtttgggttcaatcaggagagccggactggatgacgggcggcacgtacatggcgtttaggaaaattaagatgtttttagatatatgggaccgttcatccttgaaggaacaagaggacacgttcgggcgggtgaaaagctcgggcgcgcctttcggacaaaaaaaggaaaccgatcccgtgaagctgaatcaaattcccgccgactcgcatgtcagcgtggcaaaatcaaccggcagacagattctgcgccgggcattttcctatacggacggaattgatccgaagacgggctatgttgacgcaggcctgttgtttatctgctttcaaaaagacccggaccgccaatttgtcccgatgctgaaggctttggcggcaaaggatgcgctgaatgaatacacacaaacgatcggctcttccttattcgcctgtcccggcggctgtaaaaaaggagaatatatcgcccaaaggctgctggaatcgtgacaccttccatatggagggtgttttttttaaaaaaaacacttgtaactataaaagttacaacttaaaatgataaggaaaggagacttacaatgacactgcagattaaagtatattctgattatgtatgtccgttttgctatgtcggcaaagcggcgtttgaagaagcaatcaaggacaaggacgtacaggtggaatggatgccgtttgaattgcgtccgagcccctcgccgaaacttgatccggtgaatgatcccgccaagcggcagatgtggaaaaactccattgagccgatggcgcagtcgttaggcgttgaaatcacgttcccccgcgtgtcaccgcatccatacacggatttggcatttgaaggctttcatttcgcaaaggaacacgggaaaggaagcgaataccatacacgcgtttttcaggcgttctttcaggaagaacaaaatatcggtgacgttggcgtgctgacaaagcttgcggaagaagccggacttgacggcgctgccttcaaagaggcgcttgagacaagagcgtacaaggacgtacagcgggaagcgctccgccatgcttatgaggaagccggcattacggcagtgccgacgtttatcatcggcgatgagagaatccctggcgcggcgggaaaggaaacctttgaacaaatcattgagcgggaactgaataaacgttaacccgaaaaaagccctctcgatcagcgagagggctttgccatatagtgtttgacaaatgtttgtctgtccgcttcatatgccgcggcgtcaaaggagtcgccgcaaaaatgaaggcaccaagggtctttctggcaggcgacgccgacttgatagccgtgtttttgaaattcgagcgactgtgatgtgtcgtaaaaatgaaagccgcgaaacaaatcctcccgccactccacgtcatattgagccgccattaacaagccgtcaatggcgtcagcgggcgtaaacaggccgtcttcatcaccgtgctcaaaatccagcgggtgataagcattcccccggtattcaatcacttttcccatccgctgtccgctttcccaccaaatgccgttcggcggcagggttttgcagccggcgacaccgagaaggccgagctcctgatgagattgaaagatatgaagcatgtcatgaaggaaatgctgatgaatgataaaagtatcctgatgcagataaattttatatttggaggggtgtttcagcgctttgttgtaggacgaggccatgcttgctgaatcgtatatcggcatgatatcaacggagtatgaagggggacggtaagctgcatgatatggctcttgcaccgggagtacagcgactcatcattcacacagacgacaaacagaaatgaatgtgaatccattacatgctcctctcggcctcaatcacatattgataggccgatgcttctgtcataaagtcatgccttatgccaagctgtacgcatacttcgtgcaatgatgcgatggctttgtggtaagaagggtgatcaacgcggatcgcctcaatgcgtttgacctcatagctggcggctttaaataatgaaagagtctcttcccgggtaaaaaaacgcaggtgggtctgatccattaatccggcgtcactgtaagtccatttgccggctaaaagctccaacacgactgagatgtggccgacattcggtatgcatgcaagcacagtgccgtctttttttacataaggacgaagctttttcagcactgtccacgggtcgacaagatgctcaagaacgtctccgaacagcatgcagtcgaattgctctgattcgtacggaagaatggcggattcaatgtcgccgcaaagcacgtggctcaatttgctttccgccttttttgcggcttcgggatacgcttcaatgccgtaaaccgttattccgcggtcttcgatcgccgctcctaaattgcccgtgccgcagccgacatcaagcactgtccgccagttttcgtctattttgttcaataaataaggattcaggccttcgtagtagttctgttgtttttcatcataatagggattcgtatccatctgtgtatcacctcataaatgggcataatacacaagatatgcagcggggggatctcatatcaccatgtttggctgttcaattgcggaatgcggacgggaatggttgtccggtatacggtttgttctctgattcccctcttattgcgggtgttcctttgaaaactcgggtgcgggcggactgtggcaggtcatatagtaaaaggatccgcctgtaatcttaccgctggcggatggtgtttttcattggtgtttttttcttcaccgctttttcagtatttaagaagcgcctcacatcgtcaatgtgcaaacccatgattctagcctcttgaattaacaattgccaatcttgatctatatctttcattacatgagttttcataagaacctccaattgaaaaattgatttgcccagctacagcagccaatgtataacaaatatcacacatagttggccggtaatcccaaattgaagatgaattcacctacctattccctaagaaaatgactgaaataaccaaaatccttcaagaattcttacatataataataaacaaataaatactgactggatagtatgcaaataaaaataaaccatatgacctattaacatttaccctcaaaacgtcgattagcatattctttttgcataaaaaataccgcaaaagaatgattcggtgtaagataaagtgaatgatcaaacagctggggtaaaaaatgaaaaaaaacaaatttcaaattaagagagaagaaacatttgaaagttttattgacgcaggccttcatctcctgattgaaagagcttacgattcagtctcaatcgatgacatcagtaaagcggcgggtttcagcaaaggggcgttttacgttcattttgaaagcaaggaagattttctgaagcatttgttagagaggcgtcagattaaaaaaaggatcatcactggctatctcgacgaattagaaaagcaaacagagcggccgttgacgctttgtgaagccgcggccagcgcggccagcctgttgatgcggtttgtaaacagcaagcctgcctggaatgttgtgtcttttgccgttcatatgcctacttacaaagtcgtcagtgaatatgaagcttatatccgcctgtataagttatggatagaagaaagcaccatgtacataaattggctcaaatcgagaaatttaatagaagaccatatagataccgagcataccgctaacatgatgtgcgcgctcatcgacggggtgattaagcaatccaatgtgctgggaaggccggttactttccgcagcatgtttgacgcgctctatgtttttgtcagcaccagaaaatcagggtaacgttcttcttgatttgacaaaaggtttagaaaagtctttcagaaagcgaggaactgccatgcgctacagagaaattatgatgtatatcattatggggatattcacgaccatcgtgaatatcgtcagtttttacattctgacgtcggcatttgagatggattacaaggcggcgactgtcgccgcttggattctgtccgttctatttgcttatgttacgaataaacggtatgtctttcagcaaaagaccgcggggatgcggagtctgatgaaagaattaacggcctttttcagcgtgcgggtactgtctctcgccatcgatctcgccatgatgattcttctggtcagtcaatttcatatgaacgaaacattggcgaaaatcgccgataacgtcattattgtagtcgtcaactatgcggccagcaagtggattgtcttcagaaaagcgaaagaagagggcgtgtcataaccgtttctttccgcgtcccggggggaaagtgtaatggtggaaggggatgcgtttgaagcgcaaaataaagaaagcgtttgctgatgtattcggggaatccgagacctgcgctttttctttgcgcccggcagagtgaatctcatcggagagctaacgggggccgctatgaggagaagacagagagaaaagctgacttttacacggcggatatcggcgccggagcgagagaactaaagggggatgacgatggcaattgagcggcacgtggaacgtttaatccagtacggattgcaaaaagagctgatttcatttcttgatattgaatatacaagaaaccgtttatatgaaactttgcatattacccatccggaggcttcagaacagaaagaaaatgaatcggcggcatcattgccggacatattggccccgatttatgaatgggcggcagaaacgggccggattgcagccgatacagacacctatcgcgacctgctgagcgcgaagatcatgggctgctttgccccgcagccgtccgagattgtgcgtcgttttgaagaaacaaaggcggtgcacgggccggagcaggcgacaaaggcgttttaccgattttcagaggatgtgtattatatccgttcggacagaatacagcggaatgtcggatggacggctgagacggcttacggaaagctggacatcacgatcaacctttcaaaaccggaaaaagatccgaaagcaattgccgctgccaaagagcagcctcaatccgattatccgggatgtgttctttgtaaagaaaatgtcgggtacgaggggagaccggatcacccggcgcgtcaaaaccttcgtgtcattccggtcattctcggcgatgagcagtggtttctgcaattttctccgtatgtgtattaccgggagcattgcatcgttttgaaagaccggcacgaaccgatgaagatcagcaaaaaaacgtttgaccggctgctgtcgttcgtcagccagtatcctcattattttctcggttccaatgctgatctgccgatcgtcggcggcagtattttaagccacgaccattttcaggggggccattatgaattcccgatggcgctggcggagacagaaagctggtacaggctgcctgactatccgaaaacggtgctgggaattgtgaagtggccgatgtcggtcatccgcctgcagagtgagtgcgcgtctgagctttccggcgcggcggatgccatcctgcgggcatggcgcggttattccgatgaggcggctgatctcctcgcctgttcaggagaaacaccgcacaatacaattacgccgattgcccggcggagaaacggtttattcgaattagatctcgtcctcagaaataaccgcacctctgatgagcatccgctgggaatttttcatccccatcaggaagttcatcacctgaaaaaagaaaatatcggactgattgaggtaatggggcttgcgattctgccgggccgccttgaacaagaaatgaaatacacggctgaagcgctgtgctcaccggacccggaggcggtcttaacggcagacccttctgcggcaaagcataaagattgggcgctcagtgtgctgcataagcggaaggtaacgaaagaaaacgcggaacagattctgaaagaggaaatcggccatgcctttgcgcggatactggagcatgccggcgtctttaaacagacagaagaaggcagagcggctttccggcggtttatccgccatttgggcgctctaccggaaaaaagccccatcccataagggacgaggcttttttttatcctctgcttctggcgatcaggctgaataagaataccacgatcgcagctccgatgattgccggaatgatggcaaagccggcaaggtgaggcccccatgtgccgagcagtccgtgcccgatccatgcgccgatcagaccggcgatcattgacccgatgattcccccgggcatactgccttttacaaataaacttccgatccagccgataataatagcgacaatcagagatacgataaaacccataaatatcacttcctattttttattatttatgcctatatgtttccttcgttttgtccatattaaacatatgaatgcgttttttataatgaacatatcaaggcgcgttccggtcttttttttcacaatgcgttgcgttaaaatggaaaccgtgtgaaaaggtgtgagcaaaggaaaaaatatttcttttgtagaatgtttaacaaaatgaaactttttgttgaccagcgatttttattatggtaaacctttatttggtattattcgttctcgctatcttttttctctatatatgctaaatgatctaaaactttttatgtttgatttacgcaagtggaaaaagctcatgcattttttgacgattttgtgacattaggtcgaaaaaaagatgaactttagaaaaaaataaagctaataagggcagattttgatagcataacaaggtagatagagaaaagattttgagaaagtacatttcagattcactacatcaataggaaggatggtgatcttcttgttcagagcatttaaaccgttacttttattagcgatgttggctgttgttttcgtactgggcggatgcagcgacatttccgttttagatccgaaaggacctgtagcagaccagcagaaagatctgattctcttgtcaatcggatttatgctgttcattgtcggcgtcgtattcgtactatttacaatcattttagtgaaataccgcgaccgcaaaggcaaagacagcggaaattacaagcccgagatgcacggcaacacgttcttagaagtagtctggacagtgatcccaattttaattgttattgcactttctgtgcctaccgtacagacgatatattcgttagaaaaagcgcctgaagcgacaaaggataaagagcctcttgttgtttatgctacttcggtagactggaaatgggtattcagctaccctgagcaggatattgagacggttaactacctgaacattcctgtagaccgtccggttttatttaaaatttcttcagcagattcaatggcatcgctatggattcctcagcttgggggacaaaaatacgcgatggcgggaatgctgatggatcaatacttacaggctgacaaagtgggaacatatgaaggccgcaacgcgaacttcaccggcgaacactttgccgaccagaaattcaacgtaaaagctgttacgcaaaaagactttaacagctgggtgaaaaaagcccaaagcgattctccaaagctgacgaaagagaagtatgacgaactgatgcttccggagaatgtcggaaaattaacgttctcttctacacacttaaaatacgttgaccacggccaagatgccgaatatgcgatggaggcgcgcaaacgccttggctacaaagccgtatcaccgcactctaaaacagacccgtgggaagatgtaaagaaaaacgaatttaaagtatccgacgataaacaagattgaaattgaacaagaaaggaggaagcccgaatgaaattgagatgggatgaattttttgtaacaggtgacccattaattctgggcgcacaagtttccattgcgctttccactatcgctatcatcgttgtactcacatacttcaaaaagtggaaatggctctggtctgaatggctgacgtctgtagaccataagaaacttggaatcatgtacattatctctgctgttatcatgctgttccgcggcggggtcgacggcttgatgatgcgcgcccagttagcgcttcctaataacagttttttagactcaaaccactataatgagatctttacgactcacggtacgatcatgattatcttcatggcgatgccgtttttaatcggtctgatcaacgttgtcgtacctttgcagatcggtgcgcgcgacgtagcattcccttacttgaacaacctgagtttctggacgttcttcgtaggtgcgatgcttttcaatatttctttcgttatcggaggttctccgaacgcaggatggacgagttacatgccgctggcaagcaacgacatgagtcccgggcctggtgagaacttctacctgctcggtcttcagattgccggtatcggtacgctgatgacgggtatcaactttatggtgacgatcctgaaaatgcgtacaaaaggcatgacgctgatgcgtatgccgatgttcacatggacgacgctgattacaatggttattatcgtattcgccttccctgttttgacagtggcattggcgctgttatcatttgaccgtttgttcggcgctcactttttcacgctggaagccggcggtatgccgatgctttgggctaacttgttctggatttggggacaccctgaagtatatatcgttatcttaccggcattcggtattttctctgaaattatttcagcgtttgcaagaaagcagttattcggttacaaagcgatggtcggctcaattatcgccatttccgtcctgagtttccttgtatggactcaccacttcttcacaatggggaacagtgcgtccgttaactctttcttctcgattacaacgatggcgatttcggttccgaccggggttaaaatctttaactggctctttacgatgtataaaggccggatcagttttacaacaccgatgctgtgggcgcttgcgttcatcccgaacttcgttgtcggcggggtaacaggggttatgcttgcgatggctgcagcggattatcaataccataatacgtacttcctcgtatctcacttccactatgtgctgatcgcgggtacggtatttgcatgtttcgcaggatttattttctggtatccgaaaatgttcggccacaagctgaacgaaagaatcggaaaatggttcttctggatctttatgatcggatttaatgtatgtttcttccctcaatacttcttggggctgcaaggtatgcctcgccgtatttacacttacggaccgaatgacggatggactgcattgaactttatttcaactgtcggagccttcatgatgggtgtcggattcttaatcctttgctacaacatctactacagcttccgctactctactcgcgagatcagcggagattcatggggcgtgggacgtacgcttgagtgggcgacttcatctgcgattccgccgcattacaactttgcggtgcttccagaagtgaaatctcaagatgcgtacctgcaattgaaagaagacaaaacggatattcatccggaaagcaagttcaagaaaatccatatgccgcacaactccggaagaccgcttattatgtcagtggcgttcggtattgctggcttcggacttgtatttgaatggttctggatgggcattgtcggcttgatcggcattctgctttgcatggtgcttcgttcatttgaatatgacaatggctactatatacctgttgaagaaataaaagagacggaaagaaagatttccgaataaaggaggcgtgatttatggaacatgcagaacacggcaattctaacgcgcctatggaatatcaatctgaaaccggcagactcaatattctcgggttttggatctttttaggggcagagattgtgttgttctcaacactatttgcaaccttcttcgttcttcaaagaagaacagcaggaggagtcttaccggctgaattatttgaagtgaagcttgtcatgatcatgacattcctgcttctgatcagcagtttcacctgcgggatcgctgttcatgaaatgcgtcgcggaagtttaaaaggcgtcgtcatttggacgatcattacgcttcttctcggtgcgggcttcgtcggatgtgagcttaacgagttcatccactatgtacatgaaggagcatctctcggtacaagtgctttctggtctggattcttcgtccttctgggaacgcacggaacgcacgtaacgatcggtatcttctggattgccggcatcttactgcaattgaagaaacgcggattaacgccgcagacgtcttcaaaaatctttatctcaagtttatactggcacttcttagacgttgtttggatcttcatctttacaggcgtctatctcatcggattggggggactataatatggcaaacaaatctgctgaacacagccactttccgtggaagcatatcgtaggttttgcgttgtctattattctgaccctgctggccctttgggttgcggtatatacggatttaagctcatcagcaaaactgtggatcattttcggattcgcatttatccaagccggtcttcagcttctcatgttcatgcacatgacagaaagcgaaaacggcgggattcaagtcggaaacacgctcttcggatttttcggagcgattgttatcatccttggttccatctggatctttgcggcgcactaccatcacggtgaccatatggatggaaaccctcctggcggtgcgaagcaacattccgaacatcaggaataaaaagaaaccctcttcgttcaggcgaagagggttttttgtgcctttattggcttcttctccggcgcaggcgcggaaggccgtaaatgataaaggcggcgatatgggcaacgatgacgttgacggcaaacaggatgatcatgagtgtgtggccgagaggggacaggctgctggttgcgtaaaagtagaagaaaacccacatgagaataattggcggtatggccgaaagagcgacttttttgttatccagccagataaagaggggtgttgcgcttgcgaccagtaaataagcaaaaaacatgtccatcttacatgtctcctttcattttatgggagcgtttccaaaatgaaatacagagaataaaatgtgtctgttttgtggtcgttttttgaacattttgttacaattattataccatgttttccaatttttgataccgctttatcgagaaatgtattgcaactattgcctcatttttggataggtacaagaaaccggaaaggtcaaataccctgtcacatttccggacaagggaatggcgcaggctgtgaacctttgctatgttcaaagaaaacatgcacagcgagggtggttttgaagtggacataacaaaagacgatgtcacagcgccggacgtcattgcgcttttgcaggagcatctgaagagcatgaccatgcattctcccccggaaagtatacacgcgctcaatgcggaccggctgcgtcagcctgacgttacgttttggagtgcgagggaaaacggcgtcctgctcggctgcggcgccttaatggagctaaacagccggcacggtgagatcaaatcaatgaaaacggctccgcatcatgtcagaaaaggcgcagccaaccggatcctccgccatatgcttgaagaagcaaggcggcggggctatcagcggatcagcttagaaaccggttctatggaggcttttctccccgccagacgcctgtatgaaaaagcagggtttcaatattgtgatccgtttgcacattataaagaggacccgaacagcttgtttatgacgttaaacatagactgaaaccccttttctgacgagaaggggttttttatcggaaaagtttcatcatgaccgaaacatttccttttctgacacgtcatatgtcgtgtagtccccaaaccgtaaaaaataaaaaggaagcaacctcatcatgttttcttgaacggtgttcatgtataataaacaatagtgacttccgatgaaaatgtaaggcgggatagaatgagtcgatataagaaacagcaaaatccctattatcagggggatttgatttttatatttggtgtgtttttaataattagtgttgcggcgatttatgcggccggacagttcgggcagtatggaggcagtgcctggatgaaacagattgtcttctatgttataggtgcgggattcatcggattattgctgtactttgatttagagcagcttgagaaactgagtctgtatgtattgattgccggcgtgctgtcgctgctccttttgcgtgtggcgccggaatccatcgcgccgatcaaaaacggagcgaagagctggtttcaaatcggcaactttaccctccagccctctgagtttacgaaaataggaattatgatgatggtcgcgtccattatatcgaaggcgggcccgaaagatcaaagatcacttcgggaagatgtcaatctgcttttgaaaattgcggcatggacggttattccaattgggatgatcgttttgcaggatgccggaacgggtgcgatctgtctgtttatcgttatggtgatggtgtttatgtcaggtgtaaactggaagctgatcaccatcatcggcggttcggccgcgcttgtgcttggcctattcttagtgcttgtaattgaatttccccatgtggcgaattcgatcggtattgcggattatcaaattaaccggattacatcgtggatgtctgactccagtgcggcaacgactcaggccgagagcgataaaagctggcaggtggatcaggccgttatggcgatcggatcgggcggcattaccggaaacggcgttcataatctgaaagtgtacgtacctgagggacagaccgactttatctttgcgattttgggtgaaagttttggatttttaggctgcgccattgcggttgtcatgtttttctttttaatttacaggcttgtggtgctgattgaccgcttgcatgcgtttaaccgatttggtgcgtttttttgcgtaggatttactgcacttatcgtgattcacaccttccagaacatcgggatgaatatcggcattatgccggttaccggtattccgctgctgtttgtcagctatggggggagctcggtgctttctacattaatcagcttcgggatcgtatataacgcaagtgtgcagctgacgaaatataaaagctacttgttcaattcttaatgtgagacggctcgtttttcgggctgtctttttttgtttagagcatttcgcttttggcatgatactctttcggatatgatatatagagaaggaggctttatatatgaacaataccatcgaaaccatacttaatcatcggtcgatccgatcatttactgacgagcttctgacagcagaagagatagatacattagtgaaaagcgcccaggcggcgtcaacgtccagttacgtgcaggcttactccatcatcggcgtaaccgataaggagaaaaagcggaagctggcggcactggccggaaaccagccttacgtcgaaaataacgggcacttgtttgtgttttgcgctgatttgtaccgccataaaaaacttgctgaggaaaaaggagaaaacattaccgagcttcttgagaatacggaaatgtttatggtcagcatcattgatgccgcacttgccgcacaaaacgtaagtgttgccgcggaatcaatgggactcggcatttgttatatcggaggcattcgaaatgaacttgatcaggtgacagaagtgcttggtacacctgaccatgtgctgccgctgttcggcttggtagtcggtcatcccgctcatccgtccggtcaaaagccgcgcctgccgaaacaagccgtatatcatgaaaacacgtacgatacgaatgaagaaaacttccgcagttatatgaaggaatatgatgaaaccatttccgattattatgataaacggacaaacggcaagcgggttgaaacgtggtctgatcaaatcctgcagttcatgaaacaaaaaccgagaacctatttaaatcaatatgtaaaagataaaggttttcaaaagaattaagaaaaaacctctcctgaccgggagaggtttttttatgtttcacgtgtaacatatttcgacaaaatggaacaaggtatataaatgtttatcatcagggatgctgataagcatacagaaagaaaaaacggcttagcagtggtacgatgttgatgaggtgacagtgatgatttcattaagtatattggatcaatctcctgtatcagaagggtgttctgcggaaagtgcactgcggaatacagtaagattggcgcaggaggcggaaaagctcggatataagaggttttgggtgtcagagcatcatttttcagagcggttggcgggctcaagccctgaagtgctgatcagccatattgcggcgaaaacgaatgacattcgggtaggatcaggcggtgtgatgcttccgcattacagcgcatataaagtggcggagaatttccgcgtgctcgaagggttgacgccgggcagaatcgatctcggattagggagagcgccgggcggaatgccgatcgcatcatgggcgctgaatgacggcgggaagcgtaatgctgatcaatatccgcagcagcttcgtgagctggcgatgtatttgcatgatgcagctgatgacaatcaccgttttccgaatctgaccgcatcaccccttattaagacggcgccggaagtctggcttctcggttcttcgggagaaagcgcgtttctgagcgcagaaatgggagcaggctatatgtttgcccattttattaatggagaaggcggagaaagcacgacagcacaatataagcgcagatttaaaccttctgcattaggtaaagaaccaaaaacggccgtggcggtgtttgtgctgtgcgcggatacggaggagaaagcggaggaactcgcggctgtcatggattatacgctgcttgcgggtgaacaggggattccgcttcacggcgtaccgtcttacgaaaccgtccgcggcaatacgtatacaccgtatgaacaaagacgaattgccgataatcggaatcggatgatcatcggaacgaagcagcaagtgaaagaacagattctggctctcagtaaagcatacggaacagaagaagtgatggctgtaaccattactcatcattttgaagataaacttcagtcataccgtctgcttcgagaagcttttgccgattaatcagaaagaaaccctgctgatgctccagcagggttgttcggttattcaatgataaaaggtttttcagtcagcacctggcttgatttccctttgttcgcggcataggccagcatataatattctcctgccggcagtgcggtgtcaccattgactttgccgttccagtcgaaatattgatagcctttatcctgctttttgtagatgccggcttggccgacaaagtcaagattactgtcatatacaaggaaggcaagctcttcggctccagccggaagataggtttcaatttggtaggttccctgcgttgtgccgtcctgtacgtcgattgacgttacgcgcggatagtccggctcttttacaatcagcagcgtcggcacttttgcgactgtttttccgccttcacgcactgtgacggttccctcataggtgcctgcctttacttttttggcattgacctttactttcgcattgacctttccggtttgatgagcggggatcacgacccggtctgtgcccgaaacggtaatgcccgtgccgttgaaagagtactcgagctgatatgattttctgatggacgattggttttcaatcgtaaaggtttcttttttcgtttcattgcctttgtctttcataaacgttccgtaagaataacttcccggggcgacaagggagtctgctttgatcgccttcatgattctgatgcttccggcgccttgcgcattatgcgggtatacgtcaccgtccgcgtccgttaaggtttccgccgtgttcataagagcggcttttatttgttccgggctccatttcggtttggcctgcttgatgacggcagctgcgccggctacatgcggggaagccatgctcgttccctgcttcgatccgtagccgtacgggtcggccggatcatgggtcggaatggtgctgacgatgtttacgccgggagcggagacgtcaggtttaatcatccacgtgtccataaccggaccgcgtgacgaaaagtctgccatttgttcagtgagcgatttagccacggataaatggaatgtcgcttttgtgccgcccgcttttaattggctgacgagtttttcgccgtcttctgatgaaagcttaaccgtcggcacggacatgcccggtacgttggcttcaatttctcccggggcattgttatacacaaccataccgatcgcgcccgcttttttggcgttgtctgctttatccacaaaggcgatgctgccccgtttgacgaccgcgacttttcctttcagatctttgccttcaaaatccttttgctcgccgatacccgcctctatgagctctgtttcttttttattcagtgcttttatgtcatcttctttgttgtaccccattactttcgctgaggaataggaaccgaaggagacggcgtactcgttcagcggcagctgtgtcgctccgacggagatagcttctctggacgctcccggagagccgacggtccaattgttcggcccgctgtttccgtttgatgtaacggccgtgacgccttctgacatcgcccagtcaagcgccgtgcttgtcgcccagtctgggttattcacagaattgccgagagaaaggttcatgacatccgctccgtcctgtacggcgcgttcaataccggcgatgacgttctccgttgttccgcttccgcccggaccgagcacacggtaggcaaggagtgtagcatccggcgctacgcctttaatcgttccgtttgccgctaccgtgcccgcgacatgggttccgtggtcagtcgacgcgcctctcggatcaccggacggcgtttcttcaggatcgtaatcgttatccacaaaatcgtatcctttatattgtccgaaatttttctttaagtcagggtgtttatattcgacaccggtgtcaataatggcaaccttgacgcctttccccgtatagccgagcttccacgcgtcatttgcccctatataaggcgcgctgtcatccatctgcggagacacggcatccttagatagggtgatgtctttatctttcagttgatcggtatgataggtgacgttcggataaaccgctttgacatcctgatcactcagcagtttcggaatttcatttgccgggagtttcatggagaagccggaaaacacttgctcatattccctgttgatttttccgtgtttaatggttttgagcgctttctttttcacttttgagcgttcgcttttcagcttgctttttgtctgtgctttgccgagttcctttgcttccgccagtgacttttccttcagctcgacgatgactgtcgtttgtttgccggtggtcatatcaatgtcaccaaatacctcagccttctcaagatcaggagtttgcggttttgaagccggcgcagcctgtgaacttgtggataaggtaaaggataagacaaaagccggaagcagataacggatgattccttttttcaatcgtgtttccccctttttctttatctaaattagaaatctagtatatatttcttgaaaattcaaaataatccttgtgacatatgactcatttatggaaattggtctgtgaataaggagggagttatacacagaatcctgtgcataactgaataaaattgtgtatatatattgttgggaacgagtgttcccatacaaaatatagatcgagtttgtggatatgtggatataccctgtgtttaagctgtgcttaaccaagggataaggtgtgtataactttttttatcggcttttccatttttcaggtcatttccatcagctttcaacaaaacttctgaaaactagtttgttttttcactcatattgtgacaaacaattcgcccggccgcgtctatcatagagtcatagggttgctagacccgctagtttttagcggagaaggatcggccgccttttccgttaaagcggagagaaaaacaggcctgcgaacaagctgtctgtcaaaaagaagcggagggatgatttgcaatgaaacgtttgctagtatctttacgggtgtggatggtctttctgatgaactggatggcgccgggtaacggaagatatccattagccgccgtgtacggaaaccaagcggcttatcataagaaagcgaagcggacggctggtgctttttcgtttgtgagccgagtccgatcggcggatttgaccgatgaaacgaaatcggcccgcggcaggctggataaaaaccgatggatgcctgtccgcaaagaattgccgaaacgggagcgcgcgggtccggcacctttacatcatatgaaaaagagggtacaatcccactaaacatatgaacgggagcgaacctcttgagaatagacaaagtattaaataacaatgcggcgttaataaaagaagacggacgggaaaagatcgtaatgggtcccggaatcgcttttcaaaagagaaaaaatgatgtgattcaaaaacataaaattgaaaaaatatttgtcgtgcacgacgaaaatgaaaagttcaaacaagtgttagaaacgcttcccgaagagcatatagaggcggctgaagatatcatcagccatgcggagggagagcttgcggcgcctttgaacgatcacatccacattgcgctggcggaccatttatcctttgcgatcgaaaggattcaaaacggccttcaggtgcacaaccgattgcttcatgaaattaaggcgctttataaaaaagaatatgaaatcggccgctgggcggttgaacacgtgaaacaaaccctcggtatatcattgcctgatgatgaggcggggtatatcgcgcttcatatccacactgccaaggcggatgccaaaagcatgtattcggcgatgaagcatacaaccatgatcaaagaaatgatcgaaaagatcgaatcctttttcgaacagaaggtggatgaagacagtatttcctatcagcgcctcgtcacgcacttacggtatgcggtcagccggttggactcaaatgaagcactccattccatggacgaggagatgctttatttcatccaaaaaaagtatccgtttgcttatcggtgtgcgcttgaactggcggcgtttttaaaaaatgaatatgatttggaactgccggaatccgaggccggctatattacgctgcatgtccagcgtctgcaaaaaaacccggaataacgcgtctgtttcgagaaacagactttttttttgaaaacatattgacgaaagcgctatcatgaaataaaatgaaagcgcattaaaaaactgaatcggcgggattgtgactggtaatgcaggcaagacctaaaatttgcgtacatgaaaaagggatcatgctgacctttttcgttggcgaattttaggtcttttttgattttagaaagggggatacatcatgaattatcaagaaacggcaaaacagcttatcaaacatatcggagggaaatcaaatatcatcagcgcgacacattgcgccacacggctcaggctcgtcattcaagatgaacagaagatcagccaggccgatattgaagagacagaaggagtaaaaggggctttcagcagctcggggcaatatcagattatattcggtaccggccttgtgaataaagtgtatgacgctttttcaaaagaagccgatttggggcgggaggatcgtgagacacatcaggacgcggcgaaaaaaaagctgaatccggccgcaagatttgcgaaaacactgtctaacatattcgttcccatcattccggctatcgtggcaagcggacttttaatggggctgctcggtatgatgaaggctttccactgggtgtctgaacaatcatcgctgtttaagcttttagacatgttttcaagcgcggcgtttatcttcctgcccgtattcatcgggttcagtgcggcgaaggaatttggcggcaatgcctatctcggtgccgtgctcgggggattatgatccatccggcgcttttgaatccgtgggggcttgcggatgcatcgcctgattttatgcaactcttcggcttcgacattgcgctgctcggctatcaagggacggtcatccccgtactgttagccgtttacattatgagcaaagtggaaaagggcacgagaaaaatggtgcctcacgcattcgacttattggtcaccccgtttgtcacggtgattgtcacaggatttatcacctttatcgcaatcggtccgcttggcagggcgatcggatcgggcattaccgtctcgctgacatatgtgtatgatcacgcgggcattgttgccggacttcttttcggcggtctttatccgcttattgtgctcaccggtgtgcatcacagctttcatgcgattgaggccggcctcatcgctgatttgggcagaaactatatccttcctatctggtcgatggcgaatgtcgctcagggcgcggcgggactggctgtatttttcctgacgaaaaaagcgaaaatgaaagaaatcgctctgcctgccgcattttccgcttttctcggcgtaaccgaaccagttattttcggtgtgaacctaaggtaccggaagccgtttatcgcgggaatgatcggcggagcgctgggaggggcctatgtcgtggtgaccggcgtcgccgccaatgcttacggtctgaccggaattccgatgattgccatcacggctccgctcggtttaggaaatcttataaactatctgatcggaatgggcatcgcctctgtctcggcgtttattgccgcttacattatgggagctaaagaaaaggaggccgtcaaatgaggacaccggatcaagagctgcgcctgcaggctgaggaagcgaaaaagaagcggcaagaaacagccgcgtcagatccataccgccagaactatcatgttatgccgccggtcgggcttttaaatgatccgaacggcgtcatccaatggaacggcgtatatcacttgttttttcaatggcagccatttcatacggggcacggcgcgaaattttgggcgcatgtgacgacgaaagatttcgttgagtggaaagaggaagaaatcgcgcttgcgccgggtgagtggtatgacaaaaacggctgttattccggaagcgccatcgaaaaagacgggcggctctgcctgatgtacacaggcaatgtccgtgacggagaaggaaatcgggaaacgtatcaatgcctcgccgtatccgaagacgggatcgtatttgaaaaaaaaggaatcgtcgtgcgtctcccaaaaggctataccgctcatttccgtgatccgaaggtttggaagaaagacggagcgtattacatggtgctcggcgcgcagacagaaaagctcaccggaagcgctgtattgttcacatcagagaacctgacggattggacgtttctcggttcgattgcgggggcggactcgggcggtctcgggtcattcggctatatgtgggaatgtcccgacctgttttctcttgacggaaccgacgtgctgctcgtatgtccgcaggggcttgaagccgacgggataaaatatcataacagccaccaggcgggctatttcctcggcaggctgcatacagagccgccagaatttaagcacggtgaatttacggagcttgacagaggatttgatttttatgcggcgcagacgctggaagatgataagggacggaggattctgttcgcgtggatgggcgttccggatcagcatgaggacaagcatccgacacatgcgtatcactggattcactgcttaacgatgccgagacagctgtcactgtccaacggcagaatcatacagcgcccgctcccggaaatgaaatcgcgccgcacggatgaacaaaagcgccgtcttcaattgaattgctcgtctgtaagcctcccggtgaaagatgcgtcccgggctgaagtgctgctggaagacattacttgcgaatccggttttgaaatctcaattcggggcgcggcccggtttatatttcatcaggaagaggggctggctgtgctggagcgcaccgctttcagcggagaagaaaaagaaaagagaagctgcgccatcagcgagctgcattccgtccagctctttctggatgcatcctccattgaattgtttttgaatgatggagaagaggtattcagcgccagatattttcctttcccgggaaatgatgacgtaaccgtcacttcggttgggaaaacggaaataaatgcctcaatttggacacttttgtagaaaatcgttcttttttcttatgtgaaacctatgccatctgtgctattcttcaaacgaaagcctatgattccaggaataaaaggagttgttttctcagttttgaaaaatcagaagatgacgccgaaatgtttacttgtcaaagctgcagagcaagtggaagataaacgggaagaatataaagaagtattgcttcagctgaatcgcatgctcaagagggctgagccgcacaatgaatggagtgatcggctgaggcatacatatgaacagatgaaggaatatgcgctgtttgtgcaatcgattgagatgtttttgcggtcatccgcgaaaaaaatgaaataatcccctcgatcatgagggggatatttattttattttccgctaagacgcatcgccgaatgtttagtcggtccgatgtattggttcagcgggaaggattctttgattgccgcagtgataaattcttttgccgcatagatggcttccttcacttcagcgcctttggccagttctgccgtcacggcggcggagaatgtgcatccggctccgtgcgtgtaaggtgtatcaatcatttcgctttctaatacttccgcggtttctccgtcatacagcacgtcgatcgctttttcatgtttcaatttgccgccgcctgtaatcaatacatatttcgcgccgagttcgtgaattttcttggccgcttctttcatgtcttccaccgtttttaattcatccataccgctcagctggcttgcttcaaacaggtttggcgtgatgacggttgccagcggcgccaattgggtgcgaagcgcttcggcatgctccggatacagcacttcgttcgctcctttgcagaccatgacaggatcaataacgacattcttcagctgtttttctttaatcgttttcgccgcaagctcgatgatctccacggtagggagcattcccgttttcatggcgtctacgccgattccgtcaacaatcgtcgccagctgtgcgcgaatcgtatcggcatcaatcggaaatacttgatgatcccagctgttctccgggtccatcgctacgatcacggtcaaagccgtcattccgtatacgtttttttcttgaaatgtttttaaatcggcctgaattcccgcgccgccgctggaatcagaaccggcaatagtaagtgctttgtgcattgacatatcaatggcctccatcagtgttttatatctcattatagttagattttctcccgatcacaatacggaaggcttggaggaatgatttgacagccgcggggatgtgcgtacaatacctacataagattactaggtaagggtgagaaaataaatgctcaacagggagcttgtaaagggaagcacggtcattctggtgctgacgctgctgaatgaacggcccatgtacgggtatgaacttgtgaaagaaatggagaaaagaagcgggaatgaactgcaaatgaaggaaggcacgctgtacccatcgcttcataagcttgaacgccaaagctatatttcttcttactgggaaaagcagaccaaagggcccgaccgaaaatattaccggatcaccgatgaaggaaaaaacattctagccgaacggacgaaggaatggaatctgttctccgctctgatggaccggatgctgaagcggggcgggcagaatggataaagacctttatgtgcacgaaatcagaaaagggctggaaggcaaggccggaagccgtgaattattaaaggaaatcgaaagccatattcatcatgccatttgtgttcatctggaaaaaggcaaaaccgaaagcgaagcgatggagcttattctgcgggaagtggggactccgtctgagattatctctgcttttcaaaaagcttcgacggtgcccgcgcggacttttatgctcttttatctgttctgcaactgcggtctttttgtgatgggggcgatgattacgatgatgcacgcgtggaggattcatcccgcagttgacgcgctgtggaaagggatttccgtgtcagtatggctgattatgatcggttatgtgctgtattggttccaaatcggctatcaagctggcaaagagttcggggctggcggcaaaaagcttgctgagcggacggtatgggcttcaatggtgccgaatctatgttttatgtttgtctttttgttcaatctggttccggctgggctgtttccttcggcggtcacaccgagttttgcggcagtatgcgccgttgtgacggtatgttttccgttttgcggcaaaataggtttttacgcaggcaggcagagacttgcctgatctttttcactatatacatagggaatctatataggggtgtttatatgagattaggttcgtggatgtacggcgcgtgcgcccaaatagccgttaccgtatttaccgtctgcggcttggttcttgccttgcccgttgtgagtctttttattatggttctgaatgggatgcaagacgctacttttgttgttttcagtattttgcttcttctattgttttatgcgctgggatggatttgggctgtttcgtttgcgcgtgagtggaaggtgaaacttttcgagctgcaggtcagctcgctcattccgctggcgggtatattatacttgtacattgacagcggggtgagtataccggaactgattcatgattggcatgaggatggatgtgcgcttgtcccgccggcttttgtctgcttgtgcacatgctatgcgatggtgttggtgcctgtttatcaatcaaaactgtggaatgccatggaggcgggcagacttaatgccaaggcggtatgcactgtttggggagaccttctgatcattctggttttgctggcggggatgacgtggatttgtttctgaatgggccgaaatcaaaaatccccctgatctctccgccgctttatgttttaatagaacatgagaaaaagcagaaggagcgggtcatgaatatatcaattgtcatagtcacgtataatcggattccggctttgtgtgagctgctggagtcgatttccaggcagaccataaagccttatgaagtgatcatcgtaaatgatgccggggaatcggtcgaacaagcgaagcagctgtacagcgatctgccgattcagattattgatttagaacagaatgccggacatgtggaagcgcggaacgcaggtgtgaaaaaagcgtggggtgattatatcatgctgtgcgatgatgatgatttcattacgccgggccatttggaaagaatgacggctgcacttgctgatgcggattttgtccattctgacgcggaaattgtgtcatttgaagaacggggcggcacgagatacccggtgtcacgaaagccgttcgcctatacggcggattttgcggatatgcgggtattttccacgtacgttccgtcaggcagcatgtacagacgttctctgcatgacacgttagggtattttgatccggatgtccataattattgggactgggacttttatttgcgcgccgcgaaacagcaccgtgtgaagcgtgttccttgcgcgagcgtcatatatgcgttttttgagggaggcggcaatcagtccgcggatctcggcggcaaacggaagcggtacttagaccggttaagcgaaaagcacgggcttggggagctcccgacgaaaaacttcgcggttcttctagaagagccggacatgaagaggcgggaggcgccgactgacattgtgtgggacggaaagcccgtccattcaagactgcacagttcataagggggacggacagtttgaaacagcttttaaaagacagctggtggaatcagctgaaagatgaatttgacaaaccgtattatcaagagctgagagagatgctgaaacaagaatacagcagccaaacgatttatcctgacagccatgatatttttaacgccttgcattatacgccctatgaggatgtaaaagcggtcattctcggacaggacccgtatcacgggccaggacaggcgcacgggcttagtttttccgttcagcccggggtcagacagccgccgtctttgaaaaatattttcatagagcttcaggacgatatcggctgccccgtaccgaaccacggatcgctcgtcagctgggcgaagcagggagtgcttttgttaaacacagtgcttacggttcgccgcggtcaggccaattcccacaaaggcaaggggtgggagcggctcactgaccgcatcattgatgtggtgaatgaaagagagaagccgattgtctttatcctgtgggggcgtcacgcgcagatgaaaaaagagcgcattgacacatcgaaacacattattattgaatcgactcatccgagcccgttttcggcaaggaacggttttttcgggagcagaccgttttcccgtacaaacgccgcccttgaaaaaatgggggagcagccgatcgattggtgcatccccgacctgccgcaataaacggttttttgaggcgcttccgcccggcggaagcgtcttttttgatgttccgggcggtatgccgtcagaaaaaataacaaactcaattctgcgatccgctcagaaatttgataaaatgcaggaagaagacaaattactgctggaggatttactcatgaacatacatatctctgctttaattcagaagatggaagaagaactgaggcaggcgaaaacggcgacccgcaccgaggaggtcaaaatgcacgcggccgccatccgctctctgtgtgatgtcgtgctcggcactcagacgcacaccgctccggcgcctgtgcagaatccgattccgaaagcggcgccgaaaccttccgcgtctccttcgacagacccgctgctgcttgaaaaaatgatgggcagcgccgggctgaaccaatatcagaaaaaagcgaaagacgaacgtgaggaagacggaaacggggattccattttcgatttttaacaggagaggttgattgacttgaaactgatactcgggggtttgcaatggacggcatttatgattgcggctgcgattgtagttcctgtcgccatcgcacaatcatttcacttgaaccatgccgattctgccgcattgattcagagcacattttttgtgcttggcgtcgctgcggtcatccaatgtctccagggacatcgtctgccgattaatgaaagcccggcaggcttatggtggggcgtatacacgatttacggcggactgacgggcacggtgtttgcgacattcggcgagacgctgcgggcgctgcagggggcgctgttattaagcgctgtctttttctttttgttcagcctttttaaagtgattgaacggctggccgtgctgtttacgccggttgtgaccggtgtgtatctgctgctgttggtcatgcagctgagtcagccgattgtgaaaggccttttgggcatcggctatttaaaaaacagcgtcgacggccttgtattcgggctcgcaatggttgtgacggcggcgatgttcatcatgtcccgatcgaatgttacgttcttaagacagtatgcgattctcctttcgcttgccggcggatggatcttattcgccgtcttcggcgctgccaaaccgattcaaataccggatcgcgtgattcagctgccggttctttttccgtttggaaaacccgtgtttgacagcggcctgatcattacgtcactcttcattaccgtgcttttgattgtcaacatgctcgcgagcatccgggttgtagaagcggcggtgaaaaaattcggcggcaccgttgggaaacggcgtgagcgtccggcagggtttgcggcttcgatcagccaccttttgagcgggctgtcagggggcattgcgcctgtgccgatttcaggggcggccggttttattgagacgacgaagcttccttcgaaaaagccgtttcttttgggaagtgtatttgtcatgatcatcagtatgatcccgctatttatgaatgcgtttgcgagtctgccctcaccggtcggctttgcggtaaacttcgtcgttttctccacgatggcgggtcttgcctttacggagtttgactcttatgagaaagcggagcaaaaacgaatccgttccattatcggtctggcgctcctcacgggggtcggcgtaatgtttgtgccggagagcgcgttatcagggatgcatccgatcctgatttcgctcttaagcaacggccttgtgctcggaacgctgctggcgatagcgattgaccgaatccagcttatcaaaaagaaaaaatccgacaatctcgtgtcatcggatgacggacgttgaattttgccgatgttgggttatgattgaattggaaactttaacgaaaaggcgggagaaaaatagatgaaagtgtttattattcttggtgcgattaacgctttattggccgtggcgctgggcgctttcggcgcgcatgggcttgaagggaaaatccccgataaatatttgcaggtgtggcacacaggcgtgcaatatcatatgtatcacgcgctcggtcttctggctgtcgcgtttttggctgaaaagctctctggcgcaggcagtgtttctgttgcgggctggctgatgtttgcgggcatcgttctgttttcaggaagcctgtacgtattgagcgtgacgcagatttccattctcggcgcgattacaccgctcggcggcgtggcgtttatcatctcttggattatgattatcgtcgcggccgtcaaatatttataaagaaaaaaagccaatcctctgtcaagtgagcgattggctttttgatttatctcggagaataagaagacatggagtacggataagtataagcgatttcctcatcaaatgtgatgtaatcaaggtaaatggtcagaagcagatagcgggtgcccgttttcggatcgctgatgatgatatggtcacgtcccgccgcctcaatcacaccgcggaaaatctttgaattccattctttgctgttttcgaatgtcatataaatcgtcgccgttttgccccggttcaaccgcagaatattttcaatgtatgactcttcaatcggcagcatgccgggaacgttttgtgacgatgatggacctgacgggatttgaaagctgccgccgccctgctgctgcggctggccggggaaccccccgccgaagccctgctggccttgctgcatcggcattgtcatttgctgctgcatcggcatcatttgtgatccttggccctgaggctgcggataaggattaggcccgagctgcggctggaatccctgcatatccattcccatccccatcccctgcatttgctgatattgattctttttcggtttcatattgttcctcctttgatgaaaacctcttgatgctgaaacctcctgacaagtatcagacagccgacagagcggctgctgtttttatctattccaccatatgagcccaaagaaagatttatgcgaaaaaagaaaatacgatccaatgtttccggatatcagagccggctttttttgtgcgcgcaatgctgacttttcacataatagtctgtatccctagcgcatcttccgcataaggaacatatgatagcggtagtttcaggtgcgaaaagggggtgacgagttgcctaaagtgtcagtgatcatgacgagctataacaaaagtgactatgtggcccgctctattaaaagtattctgtctcagacgtttacggactttgagctgttcattatggatgacaactcaaatgaagagacattggcggaaatacgtccttttctcacggatgaccgcgtccggttttatcaaagcgatgtatcgggcgtcaaagaaagaacggaaaaaacacgctacgccgccttgattaatcaggcaatagaaatggcggagggcgagtacgtgacgtatgcgaccgacgacaacacgtatgtgccggaacggcttgagaaaatggtgaaagagcttgatgaagacccggaaaaagccgtcgtgtattcaagttccaaaacctatcatctgaatcagcggaaagagacggtgaaggagacggccaggcccgccgaacggatcgtgtggaacgcgccgtgcgccattgaccattgttcggtcatgcaccggttttccgtgctggaacaggtcaaatcggcattcggttcctattgggatgaaagccccgcgttttaccgtatcggtgacgcccgttttttctggagagtgaatcatttttatccgttttacccgatttctgaggaacttgatatcaattatattaccgatcaatccatccattatcagcttttcgcggcggagaaaaacgagtttgtgaacagccttccgcagcagaccacgtgccgggagctgagggaatcattaaaaaagcttggaaaggggtgagggcttgtcggcatacttagcgaactattgggtgctgtaccggcagtatattgacctttttcagtcacttcgctacaaagacatcccgctcgcattgatcagtaatttttatcaatatatcagtccggcgcttcgggagagcatggagcagaacccggagcttttcggtccggcggatcagcatattcctgaagccggtattcagccttattatgatcaaaaaaggcaaaacattaagaaaacagatgagaaaccggtaaacggaaaagtcattctgcatttcgatcatcttcggttcaccgagggaaattaccggcagtttgatccggcaaaaacagcggtactggccagatggagtctgcctgaccatcatgggctgcccgttatctgcaaattggagctgacgggaatggggcaaaaagggaaccccgtcccttatattgaaaaagcccattccattttgaaagagcttcacagccatcccgctttcggaaacagagaatttcaggaacgactgtataaagacatcccgttatttattgaagcgattgacgccgttgatattttgtttacggccgagaagatttccgccgttgtagtcggcacgacggaggatatttacagccgtgtgctggcgctgatgtccgcgaaaaaaaacgccgtcagcatctgtcttcagcacggggcgctcatgggagatgaagcgtttctgcccgtatttacggactatcaggctgtattcggggcttatgaagcggagtggtataaagcaaaaggctgcagggaggaacaaatcatcatcacggggcatccccgtttcgacgagattttctcaagagagccgatagatcgggacacgttttaccgcaaactttcttttctcccgtcacagcggacggtgctgatcgccacgcagccgttttctgatgaattttatacgggagtgcttgaagagcttgccggccaaaagaacatgcagctcattattaaaccgcatccgtgggaaatcggcaaaaacaagctggatgcttacaatcaggtgctgcggaaatataaagcaggcaaaatcatcaaaaaagagatggagctgtatgatattctcccgtttgttgacgctgcggtgacacagacatcaacggtcggtcttgaagcgatgctgtttcaaaagcccgtgctgatcggaaaatcagcgggaacccgccgatacccttattatcattcacttggagaatttgtttttgaggacccgcaggcactcgctcaggaattaatccggatatgcgaaagccccgcagaatatcaaaaagcggaacaggcgcgccgtgcttttgtcgccgcgaactacccggttcaggattcgcttgccgctttatgtcaagtgcttcaggaaaaaaccggagtcagcttcagacgggttgacccttcataaaaaagataggagcgcaaaaaaaatggtgcaaaaaagatcagcttttcttccctattcattgcccatgatcgggaaggacgaaattcaggaggttattgatacacttgaatcgggctggctttcaaagggaccgaaagtagaggcgtttgaaaaagcctttgccgcctggacgggggcaaagcatgcgatcgcgctgaactcatgtaccgccgctttgtttttggccctgaaagcgaaagggatcggtcccggcgacgaggtcatcacgtctgccgtgacgttcagttcaacagccaatacaatcgtgcacacaggcgccgttccggtgtttgctgacatcgatccgcttacgctgaatgcagaccctgaaaaaattgaggcggccgtcaccccgcggacaaaagcgattgtacccgttcatttcgccgggcagtcgtgtgatatggatcaaattttggccattgccgaaaagcatcagttatttgtcttagaggatgccgcacatgccgtgtataccacttataaacagaaaatgatcggatcaatcggtgatgcgacggcattcagcttctacgcgacaaaaaacctggcaaccggtgaaggcggcatgctgacgacggacgatgacgggcttgccgatcagatcagggtgctcagccttcacggcatgagcaaaggcgcgtggaaccgctattcttcaaacggaagctggtactacgaggtcgaaacgcccggctataaaatgaatatgtttgatcttcaggcagcgcttgggcttcatcagctgaaacggattgacagcatgcagcaaagaagggctgaaattgctagccgctaccaggacgctttcagagacatgaaagggctcaccgtcccatatgtcagtgatgacgggcggcatgcatggcatctgtatgttcttcaaatagaggagcaggaggccgggatcagccggaacgatctgatttccgctttgaaagaccaatataatatcggcacaagtgttcattttattccggttccgttccatccgtattatcaaaaaacgtacggatataaggaaactgattttccggccgcggccgcgtattatcaccgcaccgtatcactccctctttatccgtcaatgacagatgatgacgttgaatacgtcattgcagccgttacggatatcgtcaaaggggctgattaggtgtacagactgagagaaaatcttgcacaggacatgattcatgccttcctgcatcagaagggcattcagcccgaagcctatgaatcgtcgctctgtttattggaagaaaacagccttcaaggcgtgattttatatgaaaactcttcgtgggaaagtcaattgttccgaaaaaatatcatcaatgtgaagcttgcagccgcaaacagcaccggacagctcaaaaggctgtttcaggaattttacgcggcaaggcgggcggacggcactgattttatatttattaaaataccagctgaagatatcggcgcgatgcaggtcgtgcagtcgcttccgaacgcttattttgtagggagtcttctcaagctcgtcagtccggtgcgtgtatataacagcacgccgccgtttgagattacagaagccggacccggcgacacggaagcgatcagccggctggcccgcgacgcctttacaaaaagcaggtattatcaggacccccatctcagctataaaagtgcaaaccgtctgtttgaagagtgggcgcggaataacgcggaaggcagagcttcgttacaattcctcgccaaatataagggagagaccgcgggctttgttcaggggctgtctaaaggcgatgaattcgtccttgatctgatggcggtaaagccgggatttgaaggaaaaggagcgggattccatttagctgcgcacgtgattgaacaatcattgcgctttcagcataagactgtatcagcgggaacgcagctccacaatgtaagagccatccgcctgtatgaaagaatgggatttaaagcggatgcgtccttttactactatcatgtgtggcccgggaaggaggcggactgatggcatcatgcaaaatcggaacgaagtcaatcggcgaaggttcgcccgtattcatcatcgccgaagccggaattaatcatgacggaaaactgagccaggcgtttgaattgatagatgcggccagtgaggccggcgcggatgcggtcaagttccaaatgtttcaggctgacaaaatgtatcagaaagaccccggcttatacaaaaccgctgcgggaaaaaacgtctctattttttctttggtgcaatcaatggaaatgcccgctgagtggatcgaaccgctgcttgaatattgtaagaaaaaaggcgtgctgtttttaagcacggtatgtgacgaaggctctgccgacttactgtatgcgacttccccttcagcttttaaaatcgcctcctacgagctgaaccatctgccgttattgaaatatgtcgcggggctgaagaccccgattatcttttccaccgcgggcgctgatatttcagatattcaggaggcttatcaaaccattaccggcgaggggaacaaagaaattgcgatcatgcattgtgtggcgaaatatcccgcgccgcctgaatacagcaatctgagcgtcattcccatgcttgccgccgcattcccggatgctgtgatcggtttctccgatcacagcgcccatccgtatgatgtgccgtgcgcggctgtcaggctcggagcgaaactgattgaaaagcattttacgatcgataaaaacctgcccggtgctgatcactccttcgccctcaatccggatgaattaaaagaaatggttgcggcgatccgctcagttgaagcggagctgcggcaggggcatcacgctccggtgccggaagtgctgtcgggaagctcccataaaacgacgacaccgattgaaggggatatcagaaggtttgcttacagaggcattttttcaacagcgccgattcaaaaaggcgaatattttacggcggaaaaccttgccgtccttcgtcccggccaaaaaccgcaggggcttcacccgagatattttgagcttttaactgacggcgcgcgtgcggtcagggatatccccgccgacacgggcatcacttgggatgaccttttgacgaaaggcagcccatatgatgactgacattttgtttatcattcaggcgcggatgggaagcgggcgtcttcccggcaaagtgctgaaaccgatcggcgggtatacgatcctcgatatgattgtcaaaagggttcgtcaaagtgcgttttacgatcaatcacgggataatctgatcgtcgccgcgtctgacagcaagaccgacgacattctgtctgcgcactgcctcagcaaccgctaccgtgtccaccgcggcagcgaacagcgtgtgcttgaccggtttgcacaagtcatcgaacaagtaaaaccggacatcgcagtcagactgacgggggataacccgtttgtcgacccttcgctgcttgattttctgattcaatcgcatttagatcagcacgcagactacacgtatatctgcggtacaccgctcgggatcggcggcgaggcggtgaacgcgcgccttttaacggagatcaatgcggacaaaacgctggcggacaaatatcaggagcatgtcacccttttgataagagaatcccctgagaggtaccggcttctctttcctgagcccccgcaggaactccgggctcctcacttgcggatgaccgtcgatacagaagaggactacaggctggcccgcgagctgtacgtaaaagcgggctcgcgtcctgatattccggcaaaagaattgatccatctgctgaatcgtgatccggagctcagggccattaatcaaatgatccggcaaaaagaggctgattagcgtgcgggttttgattttcgcggacgggggccgtgacatcggcatggggcacgcggttcggatgaagctgcttgccggtgccattaagaacaactgctcaataacgttctacacaaataaagaggcttcttcttatctatcatctgatcaatgggaagtgatcatcaagcctgacaagggacagaaggaatttattgtccgggaaataaacacgcgggctcccgaccttctcatattcgatctgctcgatatgccgtgtgactggctggaggaaatcaaaaagcattcatcggctcgtatcgtcttatttgaagaaaagagggaacatgtcattcatttatgcgatgccgttataaacggcatttacggcgggctgaaaagccggacggttcaaatgggcagcgccgcggtatatgaaggcccggattatatgattcttcatccgggttttgaaaaagcaaagcagctctatcagctgagaaaagaatgccgaaccatattggtctctttaggaggaagcgacccgaagaagcttgtctttaaagtgatggaagcatgccgccgcatccctgatattcagcggaaacgagtgatcatcgtcatgggcggcgcggcgcctcatgctgatgacgtgcgcgcgcatctcacacaaatgccttatgccgagatggtaaggcagacaaatgacatggccgcgcttctcacgagggctgatatggccatcgtgtccggcgggatcaccttatatgagaccatttgtacaggtgtgccctgcatcgttctttctcaagtggagcatcaaactgagacggcggaaaaattcgccgcacgagaggccgccgttcatctcggcctgggagaacacaccgcggcggacgtgctcgctcggcatatgtctgagctggctgctgattatccgagacggctcgggcttcatcagaacggaaagccgctggttgacggcaggggcattaaacgggcggcggcgattctttatgatttgtgataaaaccacacgtaaggaagtgttcatgtgaaaggtgttatcttagccggaggcaccggctcacgccttatgccgctgacaaaagcggtcaataagcatttactccctgtcggtccatatccgatgatttactggtcgatcatgaagctggaagaagcggggattacggatatcttgctgattacgcaaaaagaatatattccgcaatttcataaacttctcgaaaccggagaagagctcggcgtctcaatcacatatcaggttcagccagccgcatccggcatttccgacggtttatcatacgcaaagcggtttaccgggcgcgatccgttcgttctgcttttgggagataatatttttgaagattcattaaaaccttatacggagcgtttcgcaaagcagggaaaaggagcgaaagtgctgctgaaagaagttgacgatccggagcgcttcggcatcgccgagattgatgaggaaaacaaacggatcaagtcgatcattgaaaagccggagcagccgccgaccagactatgcgtcacggggatctacatgtacgacgcagaagtgttttcttatattgaacaaatttctccttcaaaacgcggcgaactggaaattacggatgtcaataatttatacattgaacacagtgagctgacgtatgatgtgttaacgggctggtgggtggatgcgggcacgcatgaatcgctctatctcgccggaagcctggcgcatcaggcattacagaaaggacaggagcattaatcatgccaaaatcatatttaattacagggggcgccggatttatcggccttaccttcacaaagatgatgctgaaagaaacagatgcgcagattaccgtcctggataatctcacgtatgcaagcaggccgcttgaaatagaagccttaaaaaagaacggccgtttccgttttatcaaaggtgacatttctgaaaaagaggacattgacaaagtcttttcccaaatgtatgacgctgtcattcattttgcggctgaatcccatgtggacagaagcataaatcaggcagagccgttcatcacaacaaatgtgatgggcacataccgactggccgacgcggtgttacagggaaaagccggcaggctgattcacatttccacagatgaggtgtacggagatttggcgccggatgatcccgcttttacagagacgacgccgctttctccgaacaatccgtattccgccagcaaggcaagctcagacctgcttgtcatgtcttatgtgaaaacccataagcttcctgccatcattacgagatgcagcaacaattacgggccgtaccagcaccacgagaaaatgattccgaccattatcaggcatgccgtaaacggcacgccggttccgctgtacggcgacgggatgcagatcagagactggctgtttgccgaagatcattgccgcgccattaagctcgtgctggaaaaaggaacactaggcgaaatttacaatatcggcggaggaaatgaacggacgaataaagagcttgcgtcatttatcatgaaggagctcggtgtcgaggaacggtttgctcatgtcgaagacagaaaagggcatgaccgccgttacgccatcaatgcttcaaagctgaaaaatgagctgggatggcggcaggacgtcacatttgaagaaggaatgagaagaaccattcgctggtatacagacagccaagactaatcggaaagaaggggatccgattgacgaaggtattagtaaccggagcggccggtcagctggggcgggagttatgccgccagctgaagcgggaagggtatgaagtgatcgccttgacaaaagcgatgatgaacatatccgaccagcgttcggtgcggcactcgttcagccattacaagccggatatcgtcgtcaatacggcggcatacacctccgttgacaaatgtgaaacggagctcgacaaagcgtatttaataaacggaatcggcgcttattatgccgcgcttgaggctgaaaacaccggcgcgaaattcattcacatcagcaccgattacgtcttcagcggcaaaggaacacggccataccagaccgatgatcccgcagatccgggcacgatttacggaaaaagcaaaaaactcggcgaagaactgatccggttaacgggaaaaaaccacaccattatcagaacgtcgtgggtgtacggcagcggcgggcacaactttgtcaatacgatgctgaaacttgcggatacacatgatcaggttcgtgtcgttaacgatcaagtcggagcgccgacgtacacaaaggatttagccgaaacggtgatcggtctgtttgacaggccgccgggcttgtaccacgccgcaaacagcggagtgtgcagctggtatgaatttgccaaggctatttttgaagaaagcggcagaaccgccgccgtgctgcccgtcacgacggaggaatacggaaatgagacgccgcgccccgcttactcggtgttgagtcttgagtcgattgaacggcaggggctcggcatgaggcattggcgggaagcgctaaaggattatttacaaagggagggacagtgcaagtgatcgaaggcgtaaaaattaaaaagctgatcaaacacagcgatgaccggggttttttctcagaactcgtccgtgacgatgaacatctcttagagcgtttcgggcaggcttcctggtccaaaagctatcccggcgtcattaaagcgtttcactatcatgagaaacaggatgacctgtggtttttcccgacgggccacgcccaggtcgtgctgcatgaccttcgcgaagagtcggcaaccaagggagaaacggatgtctactacatgggagaagacaatccgatgctccttctcattcccaaaggcgtcgcacacgggtacagagtgctgggcgaaaccccgctgaccattatttatttcacgacaatgtcctacaatccggatcagcctgacgaaaaaagaatcccgtggaatgatgagagcatcggatttgactggcagacggctcatcggtagcgcacaagacgaagacagcggatgtcttcgttttttgtgctggttcatctcgtgaaaaataaatgattgaatattccaaaaaataatttacttccatggataaaggtggtagattattctcaggaaaagagaaacccaattcgcgaatggaatcatcagacacgcttttccggcagaggacgctctgaatcctatatgatctggaggaattcatgatgttaaaaagaaaatcattttctgcctttctcatcagtgctgcggtattttcagctgtgttcttgccatcttttcatgcgaacgcccaatctgccgttattgaagcgaaaaccgtcaatagtacgaaagaatacgcgacgtctgatattgaagtcacatacaagccgaatgcgctgcttgccgtcggcgccgttgaatttcaatttcctgacgggttcaacgccactgtgagggactctgtaaacggaagaacactgaaagaaacgcaaattctcaactacggaaaaacggtcagacttccgcttacccttgacttattgggcgcgtctgaatacaatctcgtcctggtgcgtaaaaaccttccgcgcgcgggcacgtatacaattaaaggcgattacgtaaacggtttgggggccggcagtctctacgccgaaacaaagctggttattgacccgcgttaatccgggatgaaagaggctgacaacagcctctttttttatgcgcaaaatcctggcatgaatcttgcatataaaaaggggtgtaacgacaatgtgaaagggattgatgggttttggtgtaaaagcgcttacatttcgttctgccggtaattgaagcttacacgtaaaatacgatgaggtgataaaacatgtcagccaacccgctttctaaaagcactcagaaagatgaagaaaaagaagttcttaatttgttcttgtccacacaatcgatcataaaagaagccctgcgcaaactgggctatcctgacaatatgtatgaactgatgaaagagccgatgcggcttttgaccgtacgcatccccgtcaaaatggacaatggctcagtacaggttttcacgggctaccgctcacagcataatgacgcagtcggcccgacaaaagggggcgtgcggtttcacccggaagtcagtgaagaagaggttaaggcgctttccatctggatgactttaaaatgcggcatcacaaatcttccttacgggggcggaaaaggcggcatcatctgtgatccgcggacgatgtcattcggagagctggaacggctgagccgcggatatgtgcgcgcgatcagccagatcgtcggcccgacaaaggatattccggctcccgacgtatataccaactcgcagattatggcatggatgatggacgaatacagccgcctgagagaatttgattcaccgggattcattacgggcaaaccgattgttctcggcggttcacaggggcgggagacggcgaccgcgcaaggtgtcacgatttgtattgaggaagccgttaagaaaaaagggattccgttggaaaatgcgcggatcatcattcaggggttcggaaacgcggggagctttctcgctaaatttatgcatgacgccggcgccaaggtgatcggcatctcagacgcccacggggctttgtatgaccctgacggccttgacattgattacctgctggataagcgggacagcttcggcacggtgacgaatctcttctctgatgtcataacgaaccgggagctgctggaaaaggactgtgatattctcgtgcctgccgcaatctccaatcagataacggctgaaaacgcccatcacattaaagcctcaatcattgtggaggcggcgaacggcccgacaacgatagacgccacgaaaatcctgaatgaaagaggcgtgcttctcgtgccggacattttggcaagtgccggcggcgtgacggtgtcttattttgaatgggtgcaaaataatcaaggcttttactggtctgaggaagaagtcgccggaaaactgcgcagcgtcatggtgaattcgtttgaatccatttatcagacagcgcatacccacaaagtcgatatgcgtttggccgcctatatgacgggcatcagaaagtcggctgaagcggcccggttccgcggctgggtataagtgttatccgcaaagagattttgcatcagttatatagcggatcgcaaaatttctttgcgttttcagattgcagctgacaggttcggacaagcttcgtccgctttcggcaaagattttcctatttttatcacaaattgctatgctggtatgcttcttgcatcttcattaagcgtgagcacacattacaaaatacggggaggaattctaatgacagtttcatacgcacacgaaccatttacaaattttcaggaagagacaaataaacaatcgtttcaggaagcgctggcttatgtgaattcacagctcggcaagcattatccgcttatcatcaacggtgaagcgattgaaacggataaaaagatcatttccgtcaatccggcagataaaaaagaagtgatcggttctgtatcggcagccggaaaagaacttgcggaaaaggccatgcaggctgcgctgcaggcatttcaaacatggaaaaaagtacggccggaacaccgcgcgaatgtgctgtttaaggcggcggcgatcatccgcagaagaaagcacgaattctccgcgtacctggtgaaagaagcggggaaaccgtggaaggaagcggatgcggatacggcggaagcgatcgactttttagagtattacgcccgtcagatgctgaagctgaaagacggttctcctgtaaagagccgtgacggagaatataatcagtatcactatgagccgcttggggtgggaattgtcatttctccattcaacttcccgcttgcgattatggccggaacggcggcagccgccatcgtaacaggcaacacgatactgctgaaaccggcggatgcggcgcctgtcgtggcggcgaaattcgtagaagtgatgaaagaagcgggcctgccggacggcgtgctccaattcataccgggcgacggaggagaaatcggcgactatctcgttgagcatccgaagacgagatttgtgtcgtttacaggctcccgcgcggtcggatgccgcatctatgaacgcgccgcaaaagtacagccgggccaaaagtggctgaaacgggtcattgccgaaatgggagggaaagatacggtgcttgtagacagagatgctgatcttgatcttgccgcttcctcaatcgtgtattccgccttcggattctcaggccaaaaatgttcagccggttcgcgcgcggtcattcatcaggacgtctatgatgaagttgttgaaaaagccgtcgctttaacaaaatcactcaccgtcggaagtccggaagattttgatacatacatggggccagtcatccacgaagcatcttataataaagtcatgagttatatcgaaatcggcaaaacagaaggaaaactcctgacgggaggcgaaggtgatgattcaaaaggatactttattcagccgaccatttttgcggatgttgatgaaaacgcccgcctgatgcaggaggaaattttcgggccggtcgttgcgatctcaaaagcccgtgatttcgaccatatgcttgagattgccaataataccgattacggactgacgggcgctctgttatcgaaaacccgcgcgcacattgaacgcgcccgcgaagattttcacgtgggaaatctatacttcaaccgcggctgtacgggagcgattgtcggataccagccgttcggcggcttcaatatgtcaggaaccgattcaaaagccggaggacctgactatctgattcttcatatgcaggcaaaaacaacgtctgaagcctattaatctttcggaaatagcgcgatgaaaaagagagtcgcgctattttctctatatgagggtaagggggatggaacatgtatcagcagctcagcaaaatgcttccggaggagaaaatagaagccattacgaaatcactggtggcgttaaacagcatcaacggcacattgggagaaggaaaaaaagccgactatatcaaagatatgatcaagagctttccctactttcaggagaatccgtcacatgtgtgggagcaggcgattcctgaggacccttacggccgcaaaaatattttcgcatttattgagggaaacggcgaaagcctgaatacggtcatttatcacgctcatcttgatacggtcggcatcgaggatttcggccctttaaaagatatcgcttttgattccgaccgtctcgcggaatatttctcaaactatgaatttgatcgggatgtgcagcgggacgcccgctcaggcgagtggatgttcggaaggggttcggttgatatgcagagcggtattgccgttcatctcgccaatctgcttcacttttctgaacggcgcgatcagctgccgggccatattctgttcatggcaaacccggatgaagaaagccagcattccggcattttaaccagcatttctgaattaaaacggctgaaacaagaaaagcagcttcgttatttagcagcgattaataacgattttatcacgccgctgtatgagggtgacacgacaaggtacatatacacgggcgcggcagggaagcttttgccttgctttgcgatttacgggcgggaggtgcatgtcggagatacgctgtccggcatcgatccgaatttgatcgcgtcagaaatcaccagaagaattcacaacaatattcatatggcggaaaacattgaaggggagcttgtgcttccgccgacctgcctctaccagcgtgacaataaggaagcgtataacgtgcagaccgccgtcagcagctatgtctattttaattattttatttacgagaaaaccgccaaagaagtcatggatcagctgaccgccgtggctgacgaagcctgcaaagagacagaacaaaaattatctgattattacgacgaatactgtgagagaacgagcctgccgaaaaaagagatgtcatggaacgttcaagtgtacagtctggaagattacctgaaaaggctgagaagccgcgggatagaccctgcacagtgtatcgggcaggcatttaaaacatatgaacatcttgaactgcggatgagatgttttaaagccgtcgaagaactgcaaaaactcgatcctgagcagggagccaaggtcattattttctatgcgccgccttaccttccgcacaattatctgaaggaagaaagcacacgggaccggcttttgcagcatgtcattcaagaagcggtcgataaaacagcggcatcaaccggagaaacattcgtctttaaaaagtttttcccttatttggcggacggaagctttttatcgctgcatgaaacagatgaggaggtctccgcctttaccgataattttccgggctgggatgtcatcgggacgattccttttaatgaaatcagggaattgaatattccgtcggtcaatataggggtatacggaaaggacggccataaatggacggaacgcgtgtacaaaccgtacacattccatgtgctgccggaactcattcagcagacgacaatgcaccttttgcacagctgccgattagacatacgcacaaatggctgacataacggaataaggggatgtatatgcagggagataccaatcaaaatgaattgcagcgcacgatgaagggccggcatttgtttatgatcgccctcggcggcgtgatcgggacggggctttttctgggctccggttttacgatcagtgaagcgggaccgatcggcgcgatattggcttatgtgatcggcggatttttaatgtacctggtgatgctttgtttgggggagctcgcggttgccatgccggtcgcaggatcatttcaggcgtatgccgcaaagtttctcgggccgtcgacgggatttacgatcggatggatgtacgcattcagctgggccaatacagtggggcttgagctgacgtcggcggggattttaatgcagcgatggtttccggccgttccgatttgggtgtggtgcctggtatttggcgtcgtcattttttccattaacgcgctgtctgcgcggagttttgcggaaatggaattttggttttccagcattaaggtcatggccattgtattgtttattattctcggctgcgctgcggtattcggctttgtcggttttaacggcgggcagacggctccgtatctgtcaaactttacgacggacaaagggctttttccgaacggcgcccaagccgtgctgtttacccttgttatggtgaatttttcattccagggtaccgaactggtcggaatcgcctcgggagaaagcgaaaatccggaaaagacgcttccccgctcgatccgaaacgtcatatggcggacgctttttttcttcgtgctggcgatgtttgttctcgtgtccattttgccgtatcaaacggcaggcgtcatcgaaagcccgtttgtggctgtgctggataaaatcggcgttccttatgcggctgatatcatgaactttgtcattctgaccgccatgctgtcggtggcgaattccgggctgtacgcttcgtccagaatgatgtggtccctgtcaaaaactaagatgggccccgcttccttaacgaaactgacgaaaaaaggcgtgcctctgaaagctcttttcatcaccatcgccatctccggtttatccctgctgacaagtgtagtcgcggctgaaacggtgtatgtgtggctcatttccatctccggtatgattaccgtcgtcgcgtggatgtcaatctgcgcttcacaattcgttttccggagacgctttctcgctgaaggaggaaatctgaaggacctggcatttaaaacgcctctttatccgatcgtgccgattctcggattttcggtttacggtcttatcttaatcagtctcatctttatccccgaccagcgtatcggtctgtactgcggtgtcccgctgatgatcatctgttacgcgtattatcacttcggtatcaaaaaacgcctgaagcgtgagccggcttcttcggaaaaaggcgctgccggataagaaaaaaagcccttcgcttaaagcggcgggctttactttgtgtttcgtttggccgacagaacataggatagaacggcacagaactgaaaaccgaaaatgctgacggccatcggccaggcattttcttctccggcaataccgacaaggggagcggcagccgcaccgccgataaagggcaggagtccgagaagagccgcagcgcttcccgcgcctttctcctgtttctgcatagccaaagaaaatcccgtcgtcgtgacgatcccgacagaagaaacaatgatgaataaagaaatgcagactgccgccaggcctaaaccaaacgcaagtgataaaagcaaagcgatgctcccgatgacggcaatcatcagaccggagacaaacagcttccgttcatcatgtgttttggccatccgtccggtgatttgggtggcgcatatgattcccgcaccgtttacggcgaacagcaggctgaacatttgggccgatacgccgtagatgttttgcagtataaacggcgacccggcaatatatgcgaacatgccggtcatcacaaatgcctggctgagcgcaaatcccataaacatccggtcgccaagcaggccgcgaaacgtcatcagcgtctcccggagtccgccgcttgtccgcttttccggcgggagtgattcaggcaacaccgtaagcacggcggcagaaatgatacagccgattaccgccagcacgataaatacgattttccagccggcgaactgaaggataaatccccctgtaatcggcgctaaaatcggcgccgccccattgacgagcatcagtaatgagaaaaaagccgtcaattcttttccggaatacatatcgcgtgcggaagcccgtgcgatgacgattccggccgccccggtgaaaccttgaataaacctcatgacaattaaaaacgaaacagaagggctgaaggcgcataataaagaagacagcgtataaagcagcaatgacagaatcagcggcttccggcgcccgatcatatcactgagcggcccgacaacgatctgcccgacagccagacccaaaagacaaaacgtcaggctcagctgcgcaagtgacgctgtcgtatgaagatcggccgccacttcaggcaaagcgggcagatacatatcgagcgaaagcggcccgaatgaagcgagcgtcccgagaatcagtaccatgccgaggcctgcgcgggcggcctttgaatcagcgttattcatttcatgacccccaccttaacaaatgattctatcactatagcataaccagacggcgtattttatatcatttattgaatataaactaaatattttatttaaaaatctgaatgtaaataaaaaatcagaattagttttcatgtgaaatgtaaaatgaaatataaggatgctaaactataaaacaacaaaagatagaaaagttttacggaagaggtgttcaaagagcatgaacagcaaacaaaccgatcacatcgaaacgaaacgccgatttccggtctgtctcgcgcttgctttgacattaggcgtatttgccgcgggttctgaagagctggtgatttctccgctgcttccggatttagcgcgggctttcagctcggatgtcagtgtgctggcgctttccatcagtatttacggagtgatgatttttatcggggcgccgcttctcgttccgctgggagataaatattcccgggaactcagtctgctggcgggactgcttatatttacggccggcacggtgatctgcgcgctggcgcacaatctctttttcttctttctgggcagggcgctttccgggcttgcggcgggtgcgtttgtgccgacagcatatgcggtggtcggcgaccgtgtgccttatgcgtaccgcggcaaggtgatgggtctgatcgtgtcaagctggtcgctcgctttgattttcggcgttccgatcggctcttttatcggcggcgttttgaattggcggtggacgttttggattttcgccctcatgtctgtcctcgttgcttcgctcattttcattgaggcgcgccgcagcacggcggatgggaataaaacagaagaggaaaacggacggcaggcaggcactttccgggatgcgctgaaggtgccccgtgtccctgtatatctcacgatcactttttgcaacatgatcggtttttacggcatgtattcctttctcggcacatatcttcaccgcgtgctgccgggtgggaatacagcttcagggctgctgatcatggtgtacggaatcggtttttccatgagcgtgttcaccggaaaaatcgcagataaggcggggaaaatgcgctctttgatcgcggcattggccgtgatcagcatatggctttcctgtctcgcctatgcgccgtcatcaatgccgtttttggtcatcgggttattcgtctggggattgatgcaaagcctgacggtgaccttgctcagcactattttaagtgattgctcacagagccgccggggcaaaatcatggcattttacagtctggcgtccaatttggccgtcaccttgggttctgctgtcatgggtccggtctatgtcggatatggatatgcagctgtcggatttatctgtgcggccgtcaccctcatcggctttgtcctcagcgttttcgcatacagaaggtatggaaaatatgagcataagaccgaccaatcattgtatcggtaaaataaagtttctataattttgtaaatgtaaatttttaacaccttatattataaggtgttttctaatatataggaataattatcaatattttcaaataatattgacagcttgaacgtctatggataatatttacttaaaatttaacagattggttggtgctcatgattatattggataatagcattcaaacaaaaagcaaggcttattcaatatctaaactgattacgatcaacacgctcggtcctgaagggacaagcagtgagtacgcagcaaaaaacttcatcaccaatttcacccttctccaaggggtgaacagcaaattatcattgcatgatacatttgaatcgtgcattgaaaaaacgcttcaaagtccgctggaatacacaattgtgcctcacgcgtatgacggcattaagcacttctacatgagaccggatctgcagcttctgcaaattttcaggtgcgacaccccgatgtacggcctggctgtccggcccggttttgaatatacggatgacatgcttgataagactgtcatcgtatcccacccgtctcctatcaatttgattaagtattttacccgtaaagatgtcacgtttgatctggtgaactcaacgagcgcagccgcgaaaagagtgaaggacggtttgtccgacatcgcgctgacaaatgagctggccagacaaaagtacggccttcactttgtcaaaacatttaaaagcattcccatgagctggtcattattcggaaaaggagagattcatgatgaaaactgaacaagatttgcaggaactttatttcccgacgcctaaattaatagaatgggataacggagtaagacaatattcgtccgtcagaggcgatacggaagttctgctttcttacgttccgccgcatacaaacgtggaaccgcatcagcataaggaagtccaaatcggccttgtcgtttccggcgagctgtccatgactgtcggagatgtcacaagaaagatgacagcgctggaatcagcctatatcgcgcctcctaacgtgcctcacggcgcaagaaatgagacggatctagaagtgatcgccattgatattaaacgcctgaaagccggtgaaacctatacaagccctgaggattattttttgaatatttttaaaacgagagacttattgcctgggatggaagtcacgttcttcgtggaagactgggtggaaatcatgcttgccaacattccgggcaacggaggagaaatgccgttccataaacaccgcaatgaacagatcggcatctgcatcggcggtggctatgatatgaccattgaaggctgcaaagtggatatgacattcggtacagcttatttctgcgatccgagagaagatcacggcgccatcaacagatttgaaaaagattcaaaatcagtcaatatctttttccctccgcgctataacagagcaaaagcgaaaaaattagaggcgaaagagtcatgaacctgacggataaaacggtcctcatcacagggggcgcatcaggcatcggttatgccgcggttcaggcgtttctgaatcaagaggcgaatgtggtcgtcgcggatattgatgaggcgcagggagaagcgatgatccggaaagaaaacaatgacaggctgcattttgtgcagacggatattacagatgaaccggcatgtcaaaacgccatccggtcagcggttgacaagttcggcggattggatgtgttaatcaataacgccggcatcgaaattgtcgccccgattcatgagatggagctgagcgattgggacaaagtgctcaacgtcaatctgacgggcatgtttcttatgagcaagcacgcgctcaagtatatgctcaaaagcggcaagggcaatatcattaacacgtgctccgtcggaggagtcgtcgcatggcccgacattcccgcatataacgcctctaaaggcggcgtactgcagctgacgcgttcgatggccgtcgattacgccaaacacaacatccgcgtcaattgcgtgtgcccgggaatcattgacacacctttgaatgaaaagtcgttccttgaaaacaacgaaggcacgcttgaagaaatcaaaaaagaaaaagcgaaagtcaatccgctgctgagactcggcaagcctgaagaaatagcgaacgtcatgctgtttctcgcttcggatttatcaagctatatgaccggaagcgcgatcaccgcagacggtggatacaccgcacaatagagaaggagtgtttacatatggagagaaaaacagtattggttatcgctgaccttgggggatgcccgccgcatatgttttacaaaagcgcagccgaaaaatacaacctcgtcagctttattccgagaccttttgcaattacagcctctcatgcggcattaattgaaaaatactcgattgcggtcattaaagataaagactattttaagagtctggctgattttgagcatcccgattcgatttactgggctcatgaagatcatgacaaacctgaggaagaagtcgtcgaagaaatcgtcaaggtggctgacatgttcgcggttgacgccattacgaccaacaatgaactgtttatcgctccgatggcaaaagcgtgtgaacgtctcggcctgcggggagcgggcgtacaggccgctgaaaatgccagagataaaaacaaaatgagagccgccttcaaccgggccggcgtcaagtctatcaaaaataaacgggtgacgacgctggaagatttccgcgccgcgcttcaggaaatcggaacgccgcttattctgaagcctacatatctggcgagctccatcggcgtgacgctcatcaaagagagggaaacggcagaagcagaatttaacaaagtcaatgaatacctgaagtcgattaacgtaccgaaagcggtcacgtttgaagcgccttttatcgcggaagaatttttgcagggcgagtatgacgactggtacgaaacaagcggttattccgactatatcagcatagaaggcatcatggccgacggggaatacttccctgtggcgattcatgataaaacaccgcaaatcggattcacggagacatcgcatattacgccgtccatcctggatgatgacgcaaagcggaaaattgtcgaagctgccaaaaaggcgaatgaaggactcggcctcgaaaactgcgcgacacatacagaaattaaattaatgaaaaaccgggaagccggactgattgaatcagcggcgcgatttgcgggctggaacatgattccgaatattaaaaaggtcttcggcgtcgacatggcgcagctgttattggatgttctctgtttcggaaaagaagccgatctgccgaaaggattattggagcaggagccatgttatgtcgccgactgccacttgtatcctcagcatttcaaagagaacggccagctgcctgagacagctgtcgatttcgtcattgaaagcattgacattcccgacggcgtcttaaagggagacaccgaactcgtttctttctcggctgccgaggcgggtacatccgtggatctgcggctgttcgaagcgttcaacagcattgcggcgtttgagctgaaaggaagcaattcgggtgacgtggccgaatcaatcaaacaaattcagcagcaggcgaagctgactgcaaagtatgcgttaccggtatgaaacagctgaaaccgaactcgaagtatttgcttttcgggcaggcgctttcgtttatgggagactattgcgttctcccggccctgctcattttgtctacatactatcatgactactgggtgacgtccggcgttatcgcggtccgcagcattccgatggtgtttcagccgtttttaggcgtgctcgtggacaggctcgacagggtgaaaatcatgctgtggacggatgtgatcagaggtgtcatctttttggggctgacatttctcccgaaaggcgaatatccgctgctttttctggcgctgctgtttgtctcgtacggaagcggcgtgttttttaacccggcacgtctcgcggtcatgtcgtctttagaagcggatattaaaaatatcaacactttgtttgcaaaagccacgacgatttcgattattgtcggcgctgcagccggcggactttttctgttaggcggttctgtggagcttgccgtcgcgtttaacggggtgacctatcttgtctccgcgtttttcatcagccgcattaagcttcaatacgtgccgattcagtcagaaaacgtaagagaagcttttcagtcgtttaaagaaggcctgaaggaaatcaaaacaaatgcttttgtgttaaacgccatgttcacgatgattacgatggcgcttttgtggggtgtcgtctacagctatttcccgattgtcagccgctttttaggcgacggggaaatcggcaatttcatcctgacgttctgtatcggcttcggcggctttatcggcgccgctcttgtcagcaaatggggctttaacaacaataaagggctgatgtattttacagtgttatcgatcgtctcgcttgcgctgtttttgtttaccccgattttcgccgtgtcagtcattgccgccattcttttctttatcgcaatggaatacggtgaagtgctggcaaaggtcaaagttcaggagaacgctgcgaaccagattcagggccggatcttttcggtggcggaggcgtccatcggattgtgcatcgccgccggttccatgctgatcaacattgtagacgcggcagtcatcatggcgtttatcgtccttttggtcagcgggctgtttctgcatacaaaactggtcaataaatccttttcagaacggaataacgaatcagagcaaatccatttataaggagccttccagatggaaatcataccgtccgatgtcatcaagacacttccgaaacaggaattttcgctcgtttttcaaaaggtaaaagagatggagaaaacgggagcccagattattaatctcggccaggggaatcccgatctccccactccgccgcatatcgttgaagcattgcgggaagctgcgctgaatccttcatatcacggatacggccctttcagaggctatccgtttctgaaagaagccatcgcggaattttatgagagagagtacggggtatcggtcaatccggagacagaagtcgcgctgttcggcggagggaaagcaggtttgtacgttttgacgcaatgcctgctgaaccccggcgatatcgccttagtcccgaaccccggctaccctgagtatttatcgggaatcacaatggccagagcggagctgcatgagatgccgcttcatccggaaaacggctatctgccggattttgagcggattgatcccgccgtcctgaaaaaagccaagctgatgtttttgaattacccgaataacccgacgggcgcgactgcggatcaggcgttttatgaaaaagcggctgcgtttgcaaaaaaatatgacatccatcttattcacgattttgcatacggcgcgttcgaatttgatcagaacccggccagctttcttcaggcgaaagaagcgaaaacggtcggcgcggagctttattcattttcgaaaaccttcaatatggcaggctggagaatggcatttgccgtggggaatgagaaaatcattcaggcggtcaatgagtttcaggatcacgtcttcgtcggcatgttcggcggccttcagcaggcggcagcggcggcgctgtcaggaaatcctgagcatacggagcgtctgaagcgcacatataaagaacggattgattttttcacggcgttatgtgaaaaggaattaggctggagcattgaaaaaccgaaagggactttttatgtctgggctgaaattccgaatgaattcgagtcttcacaccagttttcggactatctgctggagcatgcccatgttgtcgtgacgcccggcgagattttcggcagcggcggaaagcgttatgtcagaatatcaatggtggcaaaacagggcgatttaagggaattcgtgctgcggattcaaaagctaggtttgtcctttccttcattacaagaaacatcccgctgagagcgggatgtttttattatatgcttttcatgctgccgccgtcggctgacacttgctgtccggtaatataggaggcttcttcagaggcaagaaaggcagccagcgccgcggtttcttccgcagttccgacacgcttcatcgggacgcctgaggcaatccgttcctccgcttccgctttagaaatgccgttttgcttcatgacattctttacgaattggtgataacggtctgtggcgataaatccgggattcagacagttgacagtaatgtgaaaaggcgcaagctgaatggcgatgtttttgctggcattaattaaagcggcgttcatcatgctgttggtaaacatattggcgccgggttctttccataggtttccgacgatattaatgattctgccgaattcgtgctgtttcatgatcgctgcggccgttttcatagagtcgatataggcgatcgttttattcgtaaaggtatttgtcatatcctctatatcgcagctttcaaaggtatccggcgagccgcccggaatgttgttgatcaatacatcaagccgtccgcattgtgatctgatctcttcaaaaatgccggctctcgccttctggtccgacatatcgccggccagaacggtgacgcccgcatccggatgtttggcgaggatctcttcttttaccgattcgatattttcgggaactcgtgaattaatgacggtatgaaagccattgtccgccagtttcagagcgatcgctttgccgatcccctggctggctcccataataaatgcggttcgttttgacaactgtctgcacccctttaccaaaatggaatctcctttacatcgtaaaaaaaaatgataaaaatagcaaattttatttaaattctgacaaagaaaaaacccgccggacaggcgggtgggtgttacacgtgcaaaaacttcggaagcgtgtcaagagacaagcggtttccgacaaaaaatgaaccgaattctccgtagcgcgcgctgacttcatcaaagcgcatttcataaacaagttttttgaactgaagcacatcatcgctgaagagcgtgacgccccattcgtaatcgtcaaaaccgacagaccccgtgataatctgtttgactttgccggcatagctccgtccgatcaagccgtggcttctcatcaggtttctgcgttcatccatagaaagcatgtaccagttgtcgttgccgcttcttcttttatccatcggatagaagcagacgtatttcgcttccggcagctcaggatacaggcgtgcgcggacatgcgggttttcatacggatcgccttctccgcttgcgaggtagttgctcagctcaaccacggacacgtaagagtaagccgggatcgtaaattcagcaagctttgatttgttaaattcaagctcgatttcgttcagctcttccattgtcgggcgaagaatcatcagcatgaaatcagctttctgtccgacgatgctgtagatggtttgcgagcctttgccttctttttgggcgacgccccatttttcaagcagtcccgtaaattcgtgaataatcgacaggcgctcatcgctggataacatcttccatgacgtccagtccattgtgcggaaatcgtgaagcgcgtaccagccgtcaagtgtttgggcggcttcgttcgttttttgctgctcactcatgtatcttcactcctatatcttttcattacattgatgccttcactatatcacagtttaaccgtttcggctgtggagaaaccttgaataatccgaagccttgtgtcagaaactaagccgtgaaacaaaccgtcaattaaattagttagaaaaataagatttctttttgaaagcgctataatagaagttggttatttgaatttagctggaagaagagtatgctgtaaaagtaagcgttttttgtcaacatagaggagggaatatcgtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtagtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcggacggacttgtcagcggagccgcacattctacagccgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattgaatatgcctgtaaacgatctttccagaggatgtaatgcggaagacgtctacaatcttgcgttaattacggctgctcaagcgctgtaatccgcaaaagccggtctttacgaggaccggctttttttatagaaagaatgtcactgcggcccagccgaacagggacaaacagagagaaccgatcaagcctgctgcgagcgcccgccagccgctatgacgaaacgccgatatatggactttcaaaccgagacccgccatcgccatgccgattaaaacataagacacttgaacaagaaacgcggaaaacgaagctgaaataacgcctgatgtatggatggcgctcattccgagaaatccgaagataaaccaagggatggggagcgaagcggcagaagccgtctttgactttccgctgcggcgcgcccgcattccgagcatgaatgcggccgggacgagcagcgcgacccgggtcagtttgacgatcaccgccatctcgacggctgcttttcctccggcgctgccggccgccgccgcatgcgccacttcgtgaagcgttgccccgcaaaaggccccgtaagccgcaggagaaaaccccaatccatgataagcaagagaatatacaacagtaaaaacggttcctaataacgaaacggcggccgcgctgatggcggctgcattttcatttgatctgatctgcggcgcgatcgcggcaatggcagccgccccgcagatcgctgtgccgcaggctgtcagcgtgctgagtgtctgatctatacggaacagccgggacagtccgtatacaacggcacccgcaaacatcatacagcagacggcaattgcaaatacgtgccagcccgcatgatagatatccgccagattcagtctcatgccaagcaggatgatgcctgctttcagcaagtatttgcttgagaacgcgatccccggctctaatgccgcccgctgtccgaatacggcgcgccagagcatgccgatcagcatggcaaggacaagcattccgagcatatgcaaaaacggcaggcggctgacatagaaagccgcaaacgcaattcctgcggtaactgaaataccctttatcatcttcatctcagtcacttcccattatcttgataactccactttactgcggtcttaatcattagtaaaatatatttatatgatctaaacgattaggaaaaataatgattaggggcgatgctttttgtattacggggaactgaaaacattcattgccgtcgtggaagaaaaaaactttacaaaggcggcgcagaagctgatgatttctcagccaagcgtcagccttcacattaaaaacctggagaaagaatttcaaaccgctttgctgaaccgctctccgaagcactttacgacgacgccgacgggggacattctctatcagcgcgccaagcagatggtctttttgtacgaacaggcgaaatctgaaatttacgcccaccatcattatgtcaaagggaagctcaaaatcgccgcgagctttaccatcggcgaatatattctgccgccgcttctcgcaaagcttcatgacgagtatcccgagctgaacctggacgtcatgatcggaaacacggaggaggtcagcgaagcggttcggatgcttcaagccgatatcggattaattgaagggcatacggggaaaaacgagctcgacattcagccgtttatggaggatgaattgtgcattgccgcaccgaacggacacccgctcgccggcagaaaaaacatcccggctgccgaattgcaaaatcaagcgtgggtgacaagggagaagggttcgggaacgagggaatatttagaccacgtccttcaatcaaacggactgcggccgaaatccatgatgacgatcagcagcaaccagggtgtcaaggaagccgtgatcagcggaatgggtctttccgttctgtcaaaaagcgtgctgcaaaaggatctgcttcacggcagcatttccgtgcttgagataaaaggattctccttaaaacggaaactgtctatcatccaatcttccattatggagaacacaaaaaacaaagaaatcttcatcgctcttttgaaaagccaatttcaatcatctcaagcggagtgatataataaacgcatggaaagcttatgacgaaagggatttaatatagatgggaaagcaaccgattgatttactgatgcagccgagctggagaatcattgaccaatccagccttggcccttattttgatgcgaagcagtcattcgcaatggatgatacgctgtgcgcctccgtaggcaaaggggaatcgcctgcgacggcacgcacttgggtgcaccaccggacgatcgtgctcggcattcaggacacacgcctgccgtttttagaggacggcgtgaaattgctggagggcgaaggctaccgtgtcattgtccgcaattccgggggcctcgcggtcgttctcgatgaaggcgtattgaatatttctcttatttttgaagatgagaaaaaaggcatcgacattgacagaggctacgaggcgatgacagagctggtgcggcggatgctgtgtccgtacaatgccgaaattgaagcatatgaaattaaaggatcgtactgtccgggcagctatgatctcagcatcggcggccgaaaattcgcgggaatctcacaaagacgcctgcggggcggaaccgcggttcagatttacctctgtgccgataaaagcggaagcgaacgcgccgatctgatcagacgtttctatcaagccgctttaaaagacaaaagcaacgatacaaaaggcgtatatcccgatatccggcccgaaacgatggcttcattaagcgaattgctgcaaacggacattaccgtgcaggacttaatgctggcgcttttgactgaactgaaggaactcagcggacgcctgtatgcagccggattatcgccggaagaggaaatggtatttgaaaaaaatctgatccgaatgctggaacggaatgagaaggtgttcggcacgcaggaaagcttggactgagtccgggcttttttatttttggtaattatatactattcagttatagtgaaaaagaatcgttatatcaaaactagtttacattatataccttatttgattaatatatttatgtaggttccaaataattctataaactgaaggagatggagatatgaactttaaaaaaataaaagaagaaaaaagaatcacgatccctacacatttgttagccggagatgcggaacaatcaggcaattctttcgcttggagcggctgggtgcttgtagtgccgagccaagaagacaatcaaaacccgaatttgaatttctctgatttagccgctcaaaagtaagataatgactgtttggagcctacgcattcgagacgaggcggtgagagtgtgacacaagagtatataagagaaattaagcggggagcactgtcatggattgttgaaaatatccattattttgatatgaaacataaagtagcgaatgatttcagatggcgccttaaaacatttatagaactcatttttcttaccaattacctgatcagaaatcaggcagatgataaggaagttgctgttttaacggagtttattacagaaaggctccgtaatgatcagcttgaagaatttattcattttgatccggacggtctcgccggattggctattgcgggtgaatttcttaccttgactgatcatccgtcacaagcttcagtgatatgggagctggaaaaattcacggcagcgcgttttgattgcagccttgctaaaattccctttcgaaaaatggatctgaagtacagtctgcaaagagcaggcgtaacctcggaaataacggatttttctgacttatatcactacacagcagctggtcaggatatcccaaatacatatatgacggatcatgatgcatacagtatcactcatacgattttttatataacagacatgggatgttcttctcttacggataaagagtatcatctgtcgtccttaaaagaaaaggtcctgaaatttctcgggatctatatctgtcttgagaatttagatattaccagtgaattattgatgtgcagctcttttttacatatcgacatggataaggacaaccataaaccgctctatgaagcagcctggaataaaatctatcggggccaaatgaaagaggggaatgtcccgagcatcacctatcaacataaacccggtttgaaaggtgaacagcgaagagaagatgtgtttaaacattgctatcatacaacacttgtcgccgcgggtgccgcgcatgcctgccttagagcagaaaggaacgattaacttgaacagattagctgaagagacggatcaatttttattatcttttgctgaacaatcgcttccggatcaaaagagcattcagctgtttgccggcttctgcaaatactacagaaagacgagccattcttccgctgtaaaagaacatactgaaaggattgcctccgctttcgttgataagtcatgctgggaagatctgtttcactgtaacacggccattgtcaatgagttgattcatatctatttaacggcaaaagcttataaaaagaagcagggaatggattcggatgatcaagtcatacgtcacggattgcaaaacggctatcttataaaaaaagaatggccttattttaaatacgccgaattcgccggtttgctgaacgagctgggaatgtcaactgaccatgaaaaagtgcgcttttacaagaattcgatatttcagcctttgctccatgacgcatggaaaagaacagctgaaaacgagctggagtttgtcgagtactgtcttcttcatttagatcagggagagcatctgcttcatcccggcttgaaggcgtccattcaaaaatggcttgtgttttgtctcggcagccgaaaaatgaaacagctgtgcaatatgttatttatccaatcgtgtatcgatccatttttttatggctgtcaagcggctcttcatcatataaataacgagaatccatccattcattgtgctccggctcttctgccggcgattgagattctgaatctggagtgtggaacatgcggatagtcaaggaacattttaatataaaaaaacagaagaatggctgctgggtttttggaagaacattcagctgcagccggaagaaatggaagcagatgatctcatgcacctgttttgcggtttagcggcatgtcatcactttgaaaaaagaaaggatacagaagaagtcattctattcttagaccgttattttggagaaaaaacgcacgaatgccatccggtcctgttcgcgtatgcgtatcatatataccgcaggatgaatgccgcaaaaagcatcttttttcataacggacttgaacaaatggtccgcggtttacaagaggaactgaaatcagagccttcctctatgatcctcatggtgttagcagcttattttggggcggtgaccccggaagaactgatcgttttcttagaaaccgcaatgaaacgtgaggccgatttgctcatggcaccgggcagcatccaggaagagcaggcagatgccctttatgccgtctcttatttgcaaatgaaaaaattgcagccttttctcacggaatggtacaaaacatcagactttgctttttcaggtttaatgttagccgagtgcagaaagtatcacattgacgccgttgcaaaatacacagccattatgaaatttctccgattcgatgaggcgctttttatacgggaagggcgggaatttctacgctttcagcagcgaagcagcggaagcttcggttatttaaatccattagcgatggaccaaggggcggtcagcggcaaattgctggaccgtcaatatttcctgccgtccgctcattatgccgccgcctctctgtctatgctgtaatgtctctcttttgaaagacggaaaaagaaatcaataaacaaataagaaagtagatcgctataaccgtcacggaataggggatgtttaacgttgaaatcgcatcacccgcacttttatttacataagcaacgaggtttaaatgcggaaagagtgtaaatttataccatgtaaattgggcaagcaaatcagttccgcccaatatactgccggcaaacagcagtaaaatggataagcaaagggagagcgcctggcttttgcacaatactgacaaagtgaacgcaatggtgacaatacttataattgatatgaaacgcaaaagcagaatgattccggatgctttgattgaactgatggtatacagactgtcatttaaatgagtatagacgagcggatatgaagcattggaaaaaccgaataacacgccgccgatcagcaaacagctcacacagtaaaataagtaaaccatgccggtaaacagaagagaggccagaaatttcgatgttaaaatccgccatcttcggttcgggcttgtagcgataaacttaatcgtcccaagggcaaactctttagaaacaaccccgctgacggttaaaatcgcagtcaagcttacgaaaatctcaagcccgtttgaagtaaccgtgccgaaaaacctccagccgttccattcataagggttgatgttatgctccaaataatagtctttattcttaacatcagcagaataataaacgcctgccgtttcagccggtttattaatttcttcctgttttttttcggcgagaagccgttctttccaattgttatccgaggaagcatctaactcatgattcataataaggccggccagcaaaacgatgagaaacaggaaaaaaagagataaaagtgtgcctttttttcgggttatttttatgaattcgttctgcgtcagatgaaatatgctcataccgcgtcctcctgatctgtaatcatcatgtatttctcttccaatgacaaagtccttgcagaaacgcgggaaatcagaatctctttctctgccaaagttttaatgatatacgggatggtatcttcctccgcttccaattcaatgatgcggctgtctttttgctgtacttgaagaataccgtcctgctctaatatttctttcgcccttgccggatgatcgaccgtgacggtaaacagctttttctgaccaaggtcatttctgctcttcatgtcttcaattcctaaaatccgtccctttttaatgtaggcaaccctgtcgcaaatctcctccatttctgacaataaatggcttgataataaaatggaaaccccttgcttcgctaaatcggaaagaatgatgcgcaattctttcatacctttaggatcgagaccgttcatcggttcatccagaattaataacccgggattgtgaagaagagaataagcgagccccaagcgctgtttcatgcctaatgagaaatgtttcacttttttgcgggcagcctgctccagtccgacttttgcaagggtattcataaggtcatccgttcgcagcgaggtgctgcgcagtttagtaaaatattttaggttttgcaaagcggtcatattcggatacatatccgggccttcaatgataaccccgatatgtctcataaaatattcaaagtcgctgtccggtctgcctctgaatgaaatggctccttctgtttttttaataagctgtacgatcattctgaaaatagtggttttacctgagccgttcggccctaaaaggccgaatatctcgccttttctcacatcgaaagaaattgactgtacaataggggtatgattgatggttttagagacatcttttaatatcagggctggttcactcatgctacttgcacaccttccttatgatttagggtaaaagccgtcaaaaccgaagaacatgcttccgatcaggccggcagcgattaaaatgagagcaatgctataccacatttttcgattcaatggtttccctccttacaatgctgacattccatttgaaatagcgcaaaaagatgcggaatatcagtttcgaaagatcaaatccggccataaacaccgccatacccgctccgaggaccatacatccgttaaaaatggctgttacaatcggcacttttatgaggagaaagaatgatccggtcatcagcatcaggccgattgccatcaaacttaacaccgcaacagaggcaaaaagaaacggtgtcagcataaacatgaagttgaacatgcccatacccagcatcaggccgaatgctttgaaaaaggagcgccatgttttctgctcctcggcatcactgatgaaaatatccgcttttaaggcgcgcgcaagtgttttggggtttcctaaattgccggcgatttgttcatcgctttttccttcagcgacgcccatttggaatatttcgccgatatcggcgagtatctctttttgctcaaattccggcagatcttttatttcccgccggagatgttttaaatattggtctttacacattcattttccctccttaatgatgctgttcactttttcggacaggtcaagccattccgattttaatgtgtgatgataaaaggcgccttcttctgttactttgtaatatttgcgtgacgggccttgatctgaagctgctgtatacgtttttaaatagttatttttcgtaagtcttcgtaatatggggtagatggtgccctccgatacagggaacgtttcacttatgaccttgattaattcataaccatataaatcttcataaagaagcagggacaacacacaaagttccaatgctccttttcgtaattggctactcatttactatcattcccatcatatctaataattgtattctctatacagtgtattgcacagtagctaatcgatcaataattcccaagaaccatttgggatgaggaattgaatctttatgcttatgtgcgggcggggaccgagatgcgcagcccttgcgggaagaaggcctcctgaacaatgtttacattaatatagatcaggatgcgcgtcattgacaaatggcaaaaacccctttttccatgacaagaaaaggggttttttgcgttattcggccattttttctaaattgccgttccggtccattttaaaggacggagacgcatgctcgtcgtcttcaaataaaactagttttctggctctgttcataattttcaccaaggtttcgtagtcttcctgaatggttttttgatctttttcaagtttttcgacggccgcttccagctgctcggttttagactgaagttcttggttttcccgttttaaacggtcattttccatctgcagggcggaagtttgctttccgctgccttcatagctctgcagaaattgaatgacgtctgccattgtgagctccgccttttggctcggctgctgaggcgccagcaaatgtgataaactagctaactcttccttgaagctttcatcgacataaggcatatgttcgccggacatgacggcttgccgatcctcttttggcgcttccgtttgaaccgtctcttcggctgcggtttcttgaatgatgtccgcatccggtgcaggcggctggtataatagtttcttcttggccggctggccgtttccgagcgcgcgcatccgctgtttccgctgtttttttgcaagctgaagcgctttttcatattgatggcgcacgacggcattccatctgaatccgcacgctgccgacgttctgtttaatttatcgcctacctcttcaaaggcgttcagctgcgtgcttccttcccggacgtgccggagcacggtttccgcaagcagcaggtcattttcctccgaccaggcgtcctgtctttgctttgtcaatgttctcaacccccaataatctttgatggtattagaatgtccagattggaaaatatttatacaaattggctgaaagaatgagagatacgcagagccttgcaggataagatgaatccttgtacaataaaacgtgatgtgatttttttcgtttttaaaatttaagatttaacatagaggaacattgaatgaagggaagcgtacatcatggctaatgaattccgagtgtgtgatgattgccaggccaccaatattaagacattgctgccgcgtttgaaagaagctgacccggatgcaaaagtggaggtcggatgtcagtcatattgcgggcccggacgcaagaaatcgtttgctttcgtaaacaaccgcccgctgtcggcgccgactgaggacgagctgattgagaaagtgaaaaagaagatcaaaaagtaaatgtgcatttttacgacagcctcgcccgatgggtcaggcttttttgcttcaaaaaatcaatgattgaaaactggaacaaaacgccggacaaattcaaggatgttttcaaattacagagccgatataatagaatcacggctaaaaaaaagagggaatgacgatggcgtatccaaacggaaaattatcagaagaaaaagtgtttaaagatcccgttcaccgctatgttcatgtgcgggacaagctgatctgggatttgatcggcacccgtgaatttcagcggctgcgccggatcaaacagctcggtacgacgtatttgacgtttcacggcgcggaacacagccgttttaaccattctctcggcgtctatgagattgtcagacgaatggttgatgatgtttttaaagggcgtcctgaatgggatgacaatgaacgcgaactctgtctcagcgccgcgcttttgcacgatttgggacatgggccgttttcgcattcctttgaaaaggtttttcatctggatcatgaagactatacgagggaaatcattctcggcgacaccgaggtgaatcaggttctcagaaaggcgggaccgggatttccgcaggatgttgccgaagtcattgccaaaacatacaaaaacaaacaggtggtcagcctgatttcgagccagattgacgccgacaggatggattaccttcagcgggacgcatactatacgggcgtcagctacggacattttgatatggaacggattttaagggtcatgcgtccgcgagaggaccagatcgtcattaagcaaagcggcatgcacgccgtcgaagactatattatgagccgctatcaaatgtactggcaggtgtattttcatcccgtgacgagaagcgctgaagtcattttgacgaaaattctccaccgtgcgaagcagctccatgaagaagggtatatattcactcatgctcccgttcatttttattccatttttgaagggaagctgacgcttgcggattatctgaagcttgatgaagccatcattttatattatttccaggcttgggaggaagaagaggacccgattctgtccgacttgtgccgccgcttcattaaccgccagctgtttcaatatgccgaatttaatccgaatgaggaaatgtcggcttattttgaactgaccgctctctttaaagaggcgggaattgatcccaattactatttagtggtcgattcttcatcggatctgccgtatgatttttaccggccgggtgaagaggaggagcgtctgccgattcatctgttaacgcagaacggccagatcaaagagctgtccaggcagtccgccattgtcgaatccatttcgggcaaacgccggacggaccataagctctactatccgatggacctcatttgcgacgattcagaaaaccctgaagcaaaattaaaaatccggcagctgctgggactgacatagaaggattttggtaaagaaggaaaaggagatgtcgggaatttgttgaaagaacatgcaaaactgatgaaggtgttctcggattctggagaaatcatcgggcggaaaaagctgcagaaaatcatttatatcgcgaagaaaatgcagtatcctttctacgaaaaatatgattttcatttttacggcccgtattccgaagaactgacgcttcgaattgaagagctgtgcaatcttgggtttctggatgaggtgaaggaaaaaaagggcggctactttcaataccggtactcgctgacggagacgggagccgagtttttacatcatgcggagcttaagatgccggatatgaagaagtacatcgacagcgtcaacagccgctcatcccggtttctggagctggtgtctacgattttgtattttgacggccttgaagctgaggaaaagaaagagaaagtgtttacgataaaaagcaaacagaaatatacggatgaagaatatgatgaggcgcttcactacatagaagagctgaaacacatttgttaaaggcgatgctttcgtctttttttatgaaaaaaccaggccgcgatgaagcgggcctggttttgtttattgtctcaatttgctgtgcttgtacgaatataaaaagtaaacgatgacgccgatgatcagccagacggcaaaataaagccacgttttcagcggcagattgaccattaaaaacaaacagcagataatggccaaaatcggcagtacgggtacaaaaggcactttaaatccccgtggcagatccttatgggtgcggcgcagaatcagtacggacagactgaccatggcaaatgtcaatagcgcgccgatgtttgagagatccgacagctctttcagatcaacaaaacccgcgatgcatgcgctgatcagtccgatcagccacgtattaaagatcggcgctcccgatttctttccgacaatggtaaagactttcggcagcattccgtctcttgccatcgcaaaagatatacgggtcgccgcataggtatgagcaagaacgacggccatcagtccgatcaccgcaccggcagcgataatgcccgccaccgcgttttgtccgacagtctgcagcacataagacatggcttccggcacattaagctgtgaatacggaaccatacccgtcatgacgagacagacgatgacgtataccaatgtacagatcaccagtgaaccgataataccgatcggcaggttgcgctgcggttttttgacttcttcagccgaagccgaaatcgcgtcaaacccgagaaacgcaaaaaagacggcagaagcccccgtaatgacgcctttaattccaaaaggcataaaaggatgccaattgcccggctttacaaaaaagcttcctgtgatgataaacagcaaaacaattccgatttttacgagaaccattatattattaaaggttttgctctctttagagccgcgtgacagaacgacggcaattaatagagtaatgatgatggcaggaaggttgacgatcccccctggctcggcacgtgcagcagactgtccggcaaaggcatgccgatttcggctaacagattattaaaataacttgaccagccgcttgccaccgctgacgccgtcaccatataaacggataagagcgtccagcccattaaatggccgacaatttctcccatggtggtataagagtaaatataggcgcttccgtaaaccgggagaacagaagcgatttcggcgtaacataatgctgcaaggctgcagacaacggctgcaatgataaaagaaaagattacggaaggcccggcgtttttcgcggctgtaatgcctgtaagaaccatgacgcccgtcccgatgacggcgccgatgcccagtaatgttaaatcaaatccacccatcgttttggcagtctgcctttttctgctttgttcaagcagctgggtgatgtcttttttttgtaggatattccgcaacacgcatccctccatccaaaagcaaaagccaagagggactctttggcttttacccgtgtcacatcttctgtgtaatcgacaatcctgtgttctgtttccccgtctgttccgtttcttttcttttccaatcatattgtctgccgcatccgatcagattatccttaccgtcaaacgcagtcacccttaatgattttacctgaatcgtgtctataaaaccagcattgcataaaaggatatggtaaaaaagagggagacaaaagtctgtgcagggcaggataaaagttgcgggcattccggccggaattttgactttctccgtaaggtatcagtaaaatgtaataaaaaacaaacaaatgatgatggatgcatcttgaaatggggagtttctgcatgaagcacgataacttgcaagcaaatgtactggattacgcgctcacgaaatatttaaagagcacgaaaaagcttgatgaggcgacaattccaaagagtataaacaatatcagaggatttattctgaggattatttaccggcacggcacgtgcacgattaaagatatattgcaggaggtcacattatcgccttccgccacgacaaccgctctcaatcatttagaaaaagaaggattcgtggaaaggtcgagaaacaatgaagaccgccgcacggtatggatgacgctttccgaatcgggaaaaatggcggccatgcaaatgattgaaaaccggcagctgctcattgacgaactgttcgaagcattgacagaggaagaaaagaaaatctttttcagcctggttgaaaaggttgtgaaataagccggcctgacatagcagcgccggccattatcaaggattactccgtatcgctgatccgtttgccggcgacggcgtaatgatcctttctcatttcttcaatcatgacaatgatcttttcttcggctgcgccagtcgtttcttttacggcttcggtcactttttcaaccagattccgtttttgttcatctgtgcggccttcaagcattttaacggttacgagcggcatggtgctgatcctcctttatcgtttcctctctttggaagagagatcacttatagtatactgaatgaaggacaatcttgcatttttaaaaaaaggggattttgacatttggacagatttttatattatccgctggagcttatgccctatgtcgtgattacgctgatcgtggcatttacgatgcatgaactggcgcacgcgtatgtcgcgtatcggttcggagacgataccgcggcgagacagggcagattaacgctcaatccgattaaacatcttgatgttttcggaacgattctaattttggtcgcgggtttcggctgggcccgtccggtgccggtgaaccgccgcgcctttaaaagaccgcggctggcgggagtgctagtttccgtcgccgggcccgtaagcaacctgcttcttgcctttatcggtttctttttgctagtgttgatgcatgcttacggaatggagctgctttctgcattcagcatggggcttgaccgctttttctctatttggattcagctgaatctcgcgctgtgtttattcaacctgctgccgcttcctccgcttgacggctaccggattattgaggatctcgtgccgccgcgggtgcgcgccaaaatgactcagtttgagagctacgggattatcgtgtttctcgtgctgtttgtgacaccggtcggctcctatgtcgtgtggccgctgttaagcgaggggagagactggattctcaaggtatttgccattatatttcaaccgcttttgtaggagggtattttcatggaagaaaaaaagaagaaaacaatcggatttaatattattaaaagtgatccgaccgacggacatggcggttttggcgccgggtcgctgagccttgacaatatttctccggtatttgtcgatgtggaagagaaggaagctttcgtagacatcggcgcaatgcatgcccgcagtgtcgttgaaaaaggcatcaaattcctgccgaacaaagatgaagtgccgaacggaaaaccgtactggctcgtgtgggtcaccatcgacagaaaaaaagaaggcccttattacgcgggtgtgacggcttgtgaaatgaccgtggacagaagtatccgcagaggctataagtcattgccggagcatgtgaatttaatggataaatcaatgaagcgccgcattatcgtggacaaaatggacgccagctcaaagcaggtgcttgctgaatttctgcagaagcatgaccaagggctctgggaacgttcatccgatgaattgaaaacaggtctgcttccgggcgaaaaataatttgtgaactttttgtgaactttataaatatttgcactatttcgcaattgtactgagtaaactgttgatacagaatcaggacatggaaagtcccgagccgaaccaagactcggggtttttcatgtttacgcggaggtttcatcatgttcaccgtctttgacatcgggccttggatcattgaagcagatacggcggaaacgagaaaacaatatgaaaaatcatgggctgatccctgcgattgcgggagctgccggaacttttccgaggcggtgaatctccttcccgccgagaaaacaagattgtttacgcagtttgggattcgtccggctgtctgtcacgatttgggggagcatggaaaggaaaacggcctgcatcattatgcgggcagctatccgattgtcggcatgcttagggaaggctggccgaagtttcacattgagagagcgggagatatccgcttttcgttttctttgcctagtacaacattttttataccgaagggttttcctgaccctattatccatctcgacttttcactcttgctcccatgggtgcttgaggaagacgcggattaagcccggcgcgcaatgcaccgggctcagtcttttttgccgagccacttatcccaccactttttgcgcggagcttctttacgggcggggacgtgttccttttcttttttagacggttccggtccgtagcacacatccgcgggctcagtgcctgcgatgaaatacgtgtaatgctttgcggcgcatccgggtcccgaagtgtagccggaagcggggtcaatatagacgcccgtgacgcccttcggcggtttaagcgctatttccggttctccttcgagcgccttctccataaagtccgcccaaatcgtcttcgcatagcttttttcttctactgaatcaatcgtgctgcttttgtcatagcctgtccacacaccggcggcaagagcccgattaaagccgatcatccagctgtctgcgctggtcgtgcctgatttcccgccgtacgtccgggtcagccggtctgaaatggtgcgtcccgtgacggaagtatagccgtttaaatcctcatcaaacatgcccgtcatcatgctcgccgtcacaaaagcggcttttttatcaagcgtctgctgatgtccgcgcggctgttcatacaagaccttgccggcggtatccgtcacttttgtgataaaggaaggggtgatttgttttcccccgtttgcgagcatcgcataggcattaaccatctcaatcgggcgcacgggttcagttccgagcgccagagacggaaggggctttaaatgttcgctgatgccgaattcctttgccgccgacacgagcttattcatgccgagaaagagatgggtcttcacggcataaatgttgtctgataacgcaagcgcctgaagcagcgtaatcggtttattggcgtagtagccgttgtaattgcttggagaataggtatctccgttgtcgtcaatctggaactctgtggcttcgcttttcatcagcgtgaccggtgtaaagccgctttgaatcgctttgtaatacaaaagcggcttgatcgtggaagccggctgccgtttcgcctgtgtcgcccggtcaaacgggcttttttcgtagtcacgtccgccgagaagcgcaagcacgcgccctgttgccggatcaatcgcggaaaagccgacctgaatgtcagagccggtacggatcgtatgtgccacagtgttttccgcgatccgctgcatgcgcttatcaagcgttgtataaacacgcaatccgctcgttgcgagctgttcgcgcgtcatgccgagctttttctcgagttctttcatcgcatcatcgtaaaaataaggcgccgttttcgccgcggttctgcttttcagcggctgataggcaagcggcgttttcttaatcctttccgccttttcttttgagatcattttttgtccggccatcagacggagaatggtttcctggcgctgtttggccttcttttcactgacatatggcgaatagccggacgggcctttcggtatgcccgccagaagcacggcttccgcatcgttcagatctttggcgtgtttgccgaaatacaggcgggaggcggcttcaattccgtatgcgccgtggccgtaatatatcgtatttacataaccttctaaaatctcgtttttggaatagttctgttcaaggcggatcgtgtaaaatgcttcgttccattttcgtttccatgttttatcatgctcaaggtagagatttctcgcgtattgctgggtgatggtgctggcgccctgaaccttggccattgcctttatgtcagccagcgcggcggcggccatccgccggtaatcaaaaccgtggtgattgtaaaagttttgatcctccaccgcaatcgcggcctgcaccgctgtcggattgatatcttttaaccgaacccagtagcgcttttccccgaaatcggtctcacctagctttgagccgtcatttgcataaagaatcgtagactgaggaacccggacggagggggcgccctgccatttcgctgcaagaagaacggatgtgaagcagacgccggccagcattccgccgatcagtgtcagaaagatgcaggcgcggatgattttgaacgtgattctgagctgttttccagatactttatccacttttgggaaccccctttttcatgattctattattatgtgaaaaaagggggttttttaaacatatcaaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacatctgaaaaagacgaattcgtctatcatgaaatggttgcgcacgtcccgttatttacgcacccgaatccggaaaacgttctcgttgtcggcggcggagacggcggtgtcatcagagagattctgaagcacccaagcgtaaaaaaagcgacgcttgtcgacattgacggcaaggttattgaatactctaaaaaattccttccgtccattgcgggcaagcttgatgatccgcgcgtcgacgtgagagtcgatgacggtttcatgcacatcgcgaaatcagaaaatgagtatgacgtcatcatggttgattcaacagaaccggtcggaccggccgtcaatctgttctcaaaaggcttctatgccggaatttccaaggcgttaaaagaagacggcatcttcgtcgcgcagacggacaacccgtggtttacaccggaactgattacaaacgtacagcgtgacgtgaaagaaatcttcccgatcacccgtctgtatacggctaatatcccgacgtacccgagcggcctgtggacatttacgatcggttctaaaaagtacgatccgcttgaagtagaggacagccgtttcttcgacatcgacacgaagtattacacgaaagagcttcacaaagcggcatttgttcttccgaaatttgtgagcgacttaatcaaataaaaacgtacggcgcaggagcgaatcttgcgcttttttacaggaaagcgagggaattattgatgagatttgatgaagcatattcaggaaaagtatttatcgcgagccgccccgactggaaagaggcggacgccatcctttacggcatgccgatggattggacggtcagctaccgtcccggttcacgattcggcccggggagaatccgcgaggtgtctatcggtcttgaagaatacagcccgtacctcgaccgtgacttggctgatttgaatttctttgacgccggagacattccgcttccgttcggcaatccgcaaagaagccttgatatgattgaagaatacgtggacggcatcctagaaaaaggcaagttcccgctcggcatgggaggggagcaccttgtatcatggcctgtcataaaagccatgtataagaagtttccggatcttgccatcattcattttgacgcgcacaccgacctgcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgctgaaaaaagtgctgccgcagcttgcgggacgcccggtttatgtcacgatcgatatcgacgttcttgaccccgctcatgcgccgggaacgggcacggttgacgcgggaggcatcacgtctaaagaattgctcgcgtccatccatgaaatcgcgcgctcagaggtcagcgtaaaaggcgccgacctcgtagaagtggcaccggtctatgaccactcagaacaaaccgcaaacacggcaagcaagatgatccgtgaaatgctgcttgggtttgtgaaatagaaagaatttcccccgcttgaaacatggcgggggatttttatattgtatataaactacttagaagttagtaaaagaaatatattattttactattaataattgatgttattgataaaaattatataatagggtattatttagtaaatacatctttagaaaggaagttagaatgaaaacagcagtagaaaatgaattggaattaaaaaagattgaaatttcagtaattaaactgataattgctgaaaagcctaataaagagatcgctaagtcattaaactactcgcagcgtaatgtcgaatatatcatagccggtctttgtaaaaagtggaatgtaagtactagagtcggtattgtttcggaagcatataaaaggaattgtatacagtgaacgaaatgaaagaaaaacccctattgagggggtttatttatatatgctaaaaaaacattctatacaggaatgccgtaaaaataaaaactgagattgtcaggtagttcaaatttgttctccatttcagaagaataaacaaaagaaataagtatgcaatattgaacaaatcaaagatagaaaaaatcaaatgattacttgtgaaaaataaactagtgtttggatgttgtgcgaaaatatttttgaatgatataagaaaaaacttaatcgcgaccgggatgttagaaaacataaatagggaataaaaagttttgatcttaatctgagcgccaagaaaatttataatgagaaataatacgaatccttcaaaaatgaccccgaacattaaaagaaacagtgcggctattgcaatgatgtaatctaaatgttttacttgctcaacaacttgtatagggatgtttttgggaattaaacttttcataaaaggtaaaagggaacttaaataaaaagctaacccgataatataaaacaaaaacgaggacaaaaaattaatgtttcgttccttaaatgaagataattcaatttgcataatcctaagaggctccttttataaagataggtgtaataaatgtttctaacatagctgctatcattaaaccgagaaatataataccaatatatttaaaagtgaatttcaaatttattttgaggagtaataaatctaaagttaatttcattcctacagaggctgcaagaagcaataccggcacttcaattattccatggggtataacaagcagtaaaaggtttaaattgtctttaatgtttcctatcgcatttcctaaaattaatccattaataattaaaacagcaaccgtgccaagcgacagcgttaacgggcctaaaaaaacaagcagactcgctactttaatattattaaagaaaatctgaaaaaaatccggacggatatttcgatttagattatttacatttgaagcggaatctgtataaatatatgctgtaaataaagcaattaaaaataagatcagacagagtatgtacaatttgactaaaacattctttttaaacaatgtattttcatccattcgttaaagggactgccagggatattgaatttaatgttttatattatgctgctgctgtacttgctgcagccaattgttctaaaacggccaatggcaagcctgcaccaagagatcctaaaacagtaatgatagccagaactgatcccgttgcggtgatagcactgacaatccaactaggagcgataattccagctctgtttaaaatatcgataacatccatgcttaaatgattatgtttcatactgaaaagagcgagaacaatgattcctgatgctactaatgtaaaaatcgctttactattttgtgtttttaaaagtagattcattttttcctccaattttttcaatatccccagcaagttaaataataaaatatattggaatctatttgaattgcggatttccgaaaaaataatagttaagaggtgaaatccgtaaaagtatctgctggcttatttcgtacaaagaaagccggaccatatgtatgatccggctttctttggtactgaaacattatacttttttttcaaaaataatatcaaaataatcagctgccccatagcctgaaatagcaggagcaaatatttgaaccagctttcacccttgctgcgaatacttttcaataatttatttatagtcttctttaggctttcctttccatcggtttacttctgcttttatgaacttgtattcgtacattgctgtataatcctccggaagtgtattggaatcgttaccttgtttttcgattttgataaacttgaatccataaatagagcgcgcagcctattaaaagaatcggaaattgccatcctgtatttccgtttttaaaataatctattaatgaccatatcagtaaagcgacagtataaaaactaaatgctattctggcggctgtacccgattggtgtttttgcatctcatccattttcttcataagaaccgctcccttaattttttttggcgttatagttgaatactttatctattcccgtatttaaagcgtgagctatcgaaaaagccagacttaaagtcgggtcatatttattattttcaattgcattgatggtttgcctggtcacattgcagagcttagccagatcattttgtgaaatatcagctgctgttctaagtttttttatattgttatccactaaaaccctccttaacttattttgttttttattttaaattttcaaatttatatatatttattttaaataatatatgtataagtgtcaaatactttttacacatttgagttctaaggtatgttttttgtttttgtaaattagttgtttatataaaaaacggcttgcagtttaacctgcaagcctaaaagtaattatcatttaaatcatagctctttgtgctacttcgaattggtgtgaaggtgtattcgtcatatctgctgttataaaaactgaggttacagctaagcaagtgagtaagaccttatacttcagcttcataaaaagttaccccccttgaatatgctgtcttgcttcttcaacttttaaaaagtatgttgaagcttttttataatcttcaagtttgtgataatatttagctgcatcaagagcaaaatcttctatatctgcatacatcatcttactttccaaaaagtcaaaactccttttcattgcatcctcatcaggtccgttcacatacaaagattttaaaaattcgaattcatgtaaataaactgaatctgctgactcttcggaatagataactccttttttatgatactcgagcgctttgtcgtatctttctaatttataatgaatctgtgtcattaaaaaatatgcttggggcaaagaaggggtcattttagcactttcaaaaacatcaatggctttttcaacataagttatagctgcttcatagtcgttcaggctttgtttgcaaagtgcgatgttatacagcgtcctgcccattaattgaggctgtttttctgtttctgccaaagaaaaagccttttgaaagtgagtaattgcccgatcatatagttttaaatccaggaaatttgctccgaataaggattggcattgtatgagcctgatatcgtatgacgactgagctttatatatttcatatgcctgccttgcgtaatcggtagatacatacgtttgtttcaaatagtagtagacttcagacatcttgaaaaagtactcggctttatcaatagtatccttaataaatgagagtttcgtctcagcctttttaaaaaattttatagccgacaaatattcccgctgatccagctcatacatcccccggaaaaaattaaaataataatcaagccgtccggtcagccgggcctgctttttatcaatatccgcgagcagatccgatagtctcggctgttcttctatccgctgcgattccagcggttcgaggtattcgagcatcagattgtggcggaattccatgagagaatagtacagatgaagatcctgatcttcttccaggcctgcaagctcttctttgatttctctccgcaagtactcggcgtccgggatgctgaaccttcgaatgtacatataccattcgttgattttttctccaaccgctgaagacgataaaacactcgccactattccgaatccctcccttccacgttatgtatatgacatattttatcattttcattcggaaggatagcgcaaaaataccgcaaacttttcccctttgacaaagccgtccgccgaaggaaccgcatttatcccgcagcctaggatttccggttttttcattttccttaaaaatcatgtttatcttcaaaaccaatcagcaaagatggtaagataggaggaagcggttgaactttttcccttgaaaacttatactattcaggttaagcgggatgatgaaaaggaagtgtcagcatgagacaggagacaccagtagccattcatgtgcaatcattcattcataacggctccgaagaagagtcggttgaatttacatcgagtggattctattacgtgagaaacggcaaaacgtatctttcctatcacgaagagcatgatttgggcaagattaaaacggtcgtcaagattacagaaaaagagattctcgtaatgagatcgggcgccatccaaatgaaacagcggttcattccgggggcatcgacactcactcaatataaactgccgttcggacaaatggagctccgtacggaaacgaaaaacattcaatctgatgtcggcggttcggaaggctccgtcaaactgacatataacatgactgtaggcgaaaaccaagaacatgtacataacatgacgatccaatataaggaggaaacaaaggcatgaatattgcggaacaaatgaaggacgtgctgaaggaagagatcaaagcggccgttctgaaagcgggcctggcggaagaaagccagattccaagcgtactgttagaaacgccgaaagacaaaacacacggtgattattccacaaacatggcgatgcagctggcgagaatcgcaaaaaaagcgccgcgccaaatcgctgaggagatcgtggcgtcatttgataaaggcaaagcttccattgaaaagatggatattgcggggcccggctttatcaacttttacatgaacaacagctacttaacaaaactgattccgtccgtgcttgaagcgggtgaacattacggagagacaaacatcggacaaggcgaaaagattcaggtcgaattcgtatcggccaacccgacgggagatcttcacttaggccatgcgcgcggcgcggcggtaggtgacgcgctgtgcagcgtgctttctaaagcgggctatgatgtgagccgtgaatactatattaatgatgcgggcaaccagattaacaacctggcgctttccgttgaagtccgttattttgaagcgctcggcctcgagaaaccgatgccggaagacggttaccgcggcgaggatattatagcaatcgggaaaaagcttgccgaagatttcggcgaccgtttcgtacatgaagaggagagcgaacgtcaggcgtttttccgtgaatacggcttaaagtacgagcttgataaacttcgctccgacctggaaaacttccgcgtgccgtttgacgtatggtattctgaaacgtcactgtacgaaaacggaaaaattgatcaggcgctcgaggcgcttcgcgaaaagggccatgtatacgaagaggacggcgcgacatggttccgctccacaacgttcggcgacgataaagaccgtgtgctgatcaaaaaagacggctcatacacttatctgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacctgattgaagaagtcggcttggatgccgtgcgttatttcttcgcgatgcgcagcgctgatacgcatatggattttgacttggatcttgccgtatccacatctaatgaaaaccctgtgtattatgcgcaatacgcacatgcacgtatttgcagcatgcttcgccaaggggaggagcagggacttaaaccggcggcagatcttgatttcagccatattcaatcagaaaaagaatatgacctgctgaaaacaatcggcggcttccctgaagcagtggcagaagcggcagaaaaacgcattcctcaccgtgtcacaaactatatttatgatctggcttccgctctgcacagcttctacaatgcggagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttcttttttttgcatataaagcgtgtgatgtaattcacaatccagcacactgagtttttgtatgataagactgatattgaatcagtgaaaggggcaagccgaatgatcaatcgtcaacatattcaattatcgctgcagtctttaagcttagtggcagggtttatggtgtgggtgctgatttcatcgctcatttctcaaatgacatcagatattcatttaagcaaaggcgagatttcattggtgacggcgattcccgttattctcggatcgcttctccgtattcctttaggatatttaacgaacaggtatggcgcgcggctgatgtttatgatcagcttcatcctgcttttgtttcccgtattttggatcagtatcgcggattctttatttgatttaatcacgggcggctttttcttagggatcggcggagcggtattctccatcggagtgacgtccctcccgaaatattatccgaaagaaaagcacggtgtcgtcaatgggatttacggtgccggaaacatcgggaccgccgttactacctttgcggcgccggttatcgctcaagccgcgggatggaaagcaaccgtgcagatgtatcttgttttgctggctgttttcgcattactgcacgttttgttcggcgaccggcatgagaagaaagtcaaagtttccataaagacacaaatgaaagccgtttaccgaaatcatgtgctgtggatgttgagcctgttttattttattacgttcggcgcctttgtcgcctttaccatctatcttccgaattttttggttgagcattttgggctgagccctgcggacgccggtctgcggacggccggctttattgcggtctctacgctgctcaggcctgtgggagggtttcttgcagataaactgagcccgctccgcattctgatgttcgttttcgcagggcttacgctgtcaggcgtcatgctgtcattctccccggcgatcggcctttatgcgttcggatcgctgacggtggcagtctgctcagggattggaaacgggacggtatttaaactggtgcctttctatttttcgaagcaagctgggattgccaacggtattgtgtctgccatgggcggactgggcggttttttccctccgctgattctggcaagtgtatttcaggcaacgggtcaatacgcgatcgggtttatggcgctttcagaggttgcgttagccagctttgtccttgtgatctggatgtattggcaggaaagaatgaaaacacatacggagagaaacagtcatagccttgattcataatgatccattcacaagattgttagttttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacacacgtatttgtttcaagaaggaatggatgcagaagagctttatctgattcaatcaggactcattgaaatcggcaagctgacatctgacggaaaagacctgacacttagaatctgccaaaaacacgatattgtcggagaattgacgctattcacagatgagccgagatatatgctcagtgcgaaagtgttagaggacggggaggtgctcgtcattaataaaaacaggctggaaaaggaattggtccaaaacggtgttttgacgtttgaatttatgaaatggatgagcacccatctgcgaaaaatccagtctaagatcagggatctgcttcttcacggcaaaaaaggggcgctctattccacccttatccgcttatcaaacagctacggggtggaacgaagcgacgggattctgattaacattgtgctgacaaatcaggatttggctaagttttgcgcggcggcaagggagagcgtcaaccgcatgctgggagacctccgcaaacaaggggttatttcgatagacgaaaccggaaaaattattttgcacaagcgggactatttacgatgcgagatcgagtgtgaaaattgtccgcttgagatctgcaatattgactgaaaaaacaagggcagccggtgtccttgtttttcagcttgtgatacatatacacatgacggcgaaaaagaagccggcatttacgatttccagaatgccgatcgttttcaccggccagtctcttccgtgaaaaaaccaggcccgcagactgcttgggataaaagcgagaaacgcccagcctgccccgagaagagccgataaaaaggggagcaagaggtgatatccccacgaccagtaagcaaaccttctgttttttctctcccgtatgaccgatttcacataaaaagaactcccgacaaaaaataaagcggattgcaagaatagaaaccaagcccagccgtcaaggattcccgttcccagccagcagctcgcaagcccgcctgaacaaaagaacaagactcccgcaatatcattcgtgagcgcccgttcgttttttcggcgggcataatgcgtatgtatgagaaacagcggcaataaaaaaacgccgatccagacgagctgcggcttatgaaagacagaaatgatcaaaaagcagcaggccggaaaaccgtaataccatatccacttttgataaggctgaagctgtttctttttcaaagcgagcgaaacgggataaaccgtcaagtaaaggaacagccagcccagaaagagcggaatatgccagaaaaccgggcctcccttgaccatgccgagtaaaaatggaatcagcagcatcgcccatgcgccgtgctgcttcggaatcatcgctttcatcgaaaccctcctttttatttcattataagtgcaaacactctcctgataagtgactttcatcatacaagctgtgaaatacatcactgccgcgcgggctcaatcgggctacactaaagctatcaatagcacaggaggctttcctatgaatcagtgtgactatttattatttctgaaacaacttcctatgtttaatgaagtgcctctgtccattgtcgaaaccttgctgaaaaacgggacgtttatccgcggctcatctgaccaatctccatcctttcttcattcacaatccgtttatattgtattaaaaggcaatatccgttttacggacagcaggctccctgaagggtcgcaaaccgttgcgctgtgggaaaaaggcgatgtgtttccgattgatgaaaaaggcgggctctctttatcgccttttatctcagtcaatgcctcaccggatattctggtactccatattccatattctatatttaagcaaatgatgtcttaccatccgcggctgcaaatgaactttttggcgatgcttcagcaaaatgtcttctgttcctatcagttgtttttgcggtatctgcatacatcactggatgaaaacgccgaacccggttcttaaacagaaccggtttttttgatgacgcgggcgtcctcatatcgtttaaaaatccttcctgctgctctgtgtgaacgttttgtgaaaaaagcagagtgtgtgacttagttcacaaggtgatgcgccgtctctgtttatagtgtacatagcatcacctgactcggaaggagtgaacgatcatgaagaaaaagaaaatgagtccgttgctcaggagattaaactatttttctcctatcgaacatcattcaaataaacatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggaccggatatgcctgatttcgaaccgagaggctgtccgcgggggccagtttttcatggtacatctacagcccgctccgtgtgaaatatccatatgtgcgaggtgtgctgatcaatttgtggcgggaagcattgcagacgcatcaaaatccgctggatgcctggaaatcgatcgttgaaaaccctgaaaaagcgaagtcctataaacaggcaagagggaaaggcggctttgtccgcgcggaatggccggaagtgctgaagctgatttcagcctctctgctgtatacagtgatgaaatacgggcctgaccggaatgtcggtttttctccgatcccggcgatgtccatgatcagccacgcgtcaggttcgcgattcatgtctttaatcggcggcccaatgctcagtttttatgactggtatgcggatctcccgccggcgtccccgcaaatttggggtgaccagacggacgttccggaaagcagtgattggtacaattcaggctacatcatcacatggggttccaacgttccgttaacgagaacgcctgacgcgcactttttggcggaggcccgctataaaggggccaaggtgatttcaatcagtcccgattttgcggaatcctcaaagtttgcggatgactggctcagtatccgccaagggactgacggagccctggcgatggcgatgggtcacgtcattctgcaggaattttacgtgaatcaagagacggaacgtttcatggaatacgcgaagcaatacacggattttccattcctcgtcaccttatcaaaagaaaatggcgtatacacagcgggacggtttctgcatgcgaaggatatcggacggcagacaaagcatgatcaatggaagccggcggtctggaatgaacagacaggtgcgtttgccataccgcaaggaacaatgggctcccgctgggacgggcagcagaaatggaatctgcacatgatcgatgaagacaccggggaacagatcgagccccgtctctccgtgctcggaatagaggacgaaatcagtacggtgcgcattccgtatttttcaaatgacggaaacaaagtgcttgagcggaatcttcctattaaaaaactggaactgaacggtgaagaggtgtgtgtcacgactgtatttgacttgatattggccaactacggcgtgaaccggggcatcggcggacaatcagccgcatcttatgatgatccccgtccgttcacacctgcctggcaggaacagatcacgggaattaaaagagaagccgttatacagattgccagggagtttgcccaaaatgcgattgatacagacggcagatcgatgattatcgtagggcgggaatcaaccactggttcaactccgacacgatttaccgcgcggtgttaaatcttgttttattggtaggcgcccaaggcgtaaacggcggaggctgggctcattatgtcggtcaggaaaagctccgtcctgctgaagggtggcagacgatcgcaaccgcaaaggactgggaaggcgtgcctaaactgcaaaacggcacctcatttttctactttgcgacagaccagtggcgttacgaagaccagccgatcagtgacttggcttcaccgatcgcttcttcatcccgctacaagcatcacgccgattacaatgtgctggcggcgcgattagggtggctgccgtcctacccgacattcaatcaaaacggcattgatctgtacaaagaagctgagaaggcgggggcggcgacacctgaagacgtaggtgcgtacgtggcctcacagcttcaggagaaaaaactgaaattcgcgattgaagacccggacaatgaagtgaatttcccaaggaatctctttgtatggcgggcaaatctgatctcaagctcaggaaaagggcatgaatattttcttaagcatctgctggggacgacgaacggtttgatgaatgacgacagcgacagcatccgccctgaagaaatcaaatggcgggagcaggcgccggaaggcaagctcgacttgttaatcaatctcgactttcgaatggccggtacggcgctgtattccgatatcgtgctgccggcagcgacatggtatgaaaaacacgatctcagcagcacggatatgcacccgttcattcatccattcgctccggcgatctcggcgccgtgggaatcgaggtcagactgggatattttcaaagcactgtcaaaagccgtttccgacctggcggaagaagtcgatatggagctggtgaaagaggtagtcgcgacgccgctcctccacgacacgatgcaggaattggcccagccgttcggaaaaatcaatgactggagcaagggcgaatgtgaagccattccgggaaaaacgatgccgaatatccaagtcgctgaacgggattacaaacacatttttcataaaatgaccgcgctcggccctcatacggctttaaaaccgagcggaacaaaagggatgagctggtcgattgcggatgaatatgaatcactcaaaaagagactgggagaaaccgattcagacggcgttgccaaaggatgcccgaatataagtgaagcaaagcaggcggcagaagcgattttaaccctgtcgtccacctcaaatggaaaggtcgccgtaaaagcatgggaatcgcttgaaaacatcacaaacctgaagctgaaagacctggcggaagaacgcgaggaagaatgctttacgttcgagcaaattacagcccagccgaaaacggtcatcacgtctccggcctttaccggctcagaaaaaggagggcgcaggtactcgccgtttacgacgaatgtggaaaaattaatcccgtggaggacactgaccggcagacaatcctattatgtcgatcatgaactgatgatggaattcggtgaaacgatggcgacatttaaaccgatcctccagcaccgtccgttcctgagcaagcggcctgatcaagagggcaaagagatcgttcttaattatttgacgccgcataataaatggtccgtccacagcatgtattttgattccctgccgatgctgacgctgttccggggcgggccgaccgtgtggatgaataaagatgacgcaaaggacacggatatcaaagacaacgattggattgaatgcttcaaccgaaacggcgttgtcgtggcgagagcggttttgtctcaccggattcctaaaggaatggcgtttatgcaccatgcccaggaccgccacatcaacgtgcccggcacaaaactgacgaataaccgcggaggcacccataacagcccgacaaggattcacgtcaagccgacccagatgatcgggggctacgcacagctcagctacggctttaactattacggtccgacggggaatcagcgcgatctgaatgtcgtcatccgcaagctgaaggaggtcgattggcttgaagattaaagcgcagatcggaatggtcatgaacttggataaatgcatcggctgccacacgtgcagcgtcacctgtaaaaacacgtggacaaaccgttccggtgcggaatatatgtacttcaataatgttgaaacaaagcccggtatcggctacccgaagcaatgggaggaccaggacaaatataaaggcggctggacgttgaaaaaaggaaagcttgaactgaaatcaggcccgaaaacaaaccggcttgcaggccttttctataacccgaaccagccgacgattgatgattactatgaaccttggaactatgattatgaaacattaacaaacagcccgcagaaaaagcaccagccggtggcgcggccgaaatcgtccttgacgggcgattttatgaatatcgaatggggcccgaactgggaggatgatctcgctggcggccacattacgggtcttgaagatccaaacgtgcaaaagatggaggaatcgatcaaaacagaattcgatgaagtctttatgatgtatctgccgcgtatttgtgagcactgcatcaatccggcgtgcgtgtcctcctgcccgtccggcgccatgtacaaacgcgaggaagacggcatcgttctcgttgatcaaaacgcatgccgttcatggagatattgcgtctcatcctgtccttataaaaaagtctattttaactggcaaacgaacaaagcggaaaaatgcacactctgctttccgcgcttggaggcggggctgccgaccatctgctccgaaacgtgtgtaggcagaatccgctatctcggcgtcatgctgtacgacgcggacaaagtggaggaagcggcctccattgaaaatgaaaaggatctctaccattcccaattagacgtttttcttgatccgaatgatcctgaagttgccaaactggcaaaagaacaaggcatcccggctgaatggatagaggccgcgcagcaatcgccgatctacaaaatgatcatcgattggaagattgcgctgccgcttcatcctgagtaccgcacactgccgatggtttggtacattccgccgctgagcccgattatgaatctctttgaaggaaaaggcagccggcaaacggcggaagatatttttccggctatcgaccaaatgagaattccgattgactatttggcccagttattaacagccggtgatacggatcatattcggtcaacgttaaagaaaatgtctgtcatgcgccagtatatgagagcagtccagacgaataaatccatcgacccggcactgatctccagtgtcggcttaacagaaaagcaaattgaagacatgtatcggctgctggcgatcgccaaatatgatgaccgctttgtgatcccgagcagccatcgagaagaagtgtctgatttatacgctgaacaaggaagctgcggcttgtcattttcaggcggccccggctcttgtttctaacttttgataaatgaggtggaacaagatgaacaccacagaccggcaaatgacattctccgctctttccattcttctctcttatccggatgaagagtggagagccgggcttcccgattggaaggctcttatccatgaaatcggcattcagcaaatccgtgagaaactgctgcactttttagaggcggcagccggcttttctccgcaagcgctgattgaacactatgtgtatacgttcgacttcgggaaaaaaacgaatatgtacgtcacctactttaactcaggcgagcaaagggagcgcggaattgaactgctgcatttaaaaaacacctaccagcaatccggtttcctgccgacagagaaagaattgcctgattatctgccgctgatgctggaattcgccgcggttgcggagattgaagcggcgagaagcgtgtttgagaaatacctgtccaatgtgagggagctggcttcccgcctcgaaaaaaatgacagcctctatgctgagctgctgcacgtgctgcaggccgcgctggaaagcatcggtgtacgtgaaagcactgaagaaggggctgctcaggcatgagcgggcagatcctgtgggggattatgccgtacatggtattgacgatctttatcggcgggcatatttaccgctatcagcatgaccagtttggctggacggcgaaatcaagcgagctgttagaaaagaaaaaacttgcggcgggcagcacactttttcactggggactgctgttcgttgtcggcggacatgtcatgggaattctgatcccggaaggcgtgtatactgtactgggcatttcagagcatacgtatcacaaaatggcgatcggcgcaggcctgccggctgggatcgcggcttgtgccggactagtgatcctgacatacagaaggctgtttgacaaaagaatccgcaaaaccagctcgccatcggatatcctgacgcttattctgctgctgttcatgatgctgtcgggcgttgcggccacgtttctcaacattgactcgaaaggatttgattacagggcaacagtcgggccgtggttcagggaaattgttttgttccggcctgacgcttctttgatggagagtgtcccgctatggtttaagtttcatatcatcatagggtacgtcgtttttatcctttggccgtttacaagattggttcacgtgttcagcctgcccctcaagtatttgacccgcagctatgttgtctatcggaaacgcacgtaaaaatccccctgcaagagggggatttttttatggtgaaaaaataaaaacataagatattttctgccaaggtaatggctgggcggcggggattcctgttatgttttatgtggaaataatatcaacaaaaggagagtgaagaatgaagcggattttcctcattttagccgcctgtctgatgacaagcgccggcgtcctgacactcagacattctcatgtattaaccggcggcacagcgggactgtcactaagcctgtcgtacttgtttcattcctcatttgcgattatcttctttctgatcaatatcccgttttatatattttctctcatcagaatgggaatcaaattcactctatccaccgtttttgcagtcactgtgctgactctgtttaccggcgcggatcactggctgccgccggtctctgtttcaccgcttgccggggcgatttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcggattgctgaaagggctcttctccttagtgtcgatagcggtcaccggtctgatcatcggcatcttcaaaaataaaatcaaaggcagctgctcgctcaatccggcattgcttcagaacatcacaaccggccagtcacaggaagtgtcatcataatcctttccgctcgtgcggagaggatttttcatatgtttacaggccggaaaacagagggtatacagagatatcggatcagatgggagagagtcgggatgctgaaaaggagactggaattttgctttttatatatgatgcttatcggagcatatgtcatatggttttttccggtttccaggcttgagttttacggagggttgctttgctatgcaagcattattttgttcagcatctattcgttaattcttgaaaaccgcacctctcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacagacgcccgatctgtccgggctgaaaggaaatcagaagcgtttctttcaatattcaatcaaggcgtctcatatgaatatcaatacaaaaagcaggctgaaggtgctcaaaaacggggatgaaacatttccggagctgtttgaagcgctccggtcggcagcatcatttatacatattgagtattacatgttcaaatcagacatgcttgggcacaagatgatggacattatgatggaaaaagcgcgtcaaggcgtggaagtgcggtttttgttcgacgcggccggcagcctgaagctggccggaaaagacattaaaaaactgaaacgcgcgggcgtgaacatcgtcccgtttctgccgctgaaatacggttttttcaaccaaaagttcaatttcagaaatcaccgcaagatcgtcatcgttgacgggaaaaccggttttgtcggcgggctgaatgtcggcaaggagtatatcggcaaagaccaaagtgtcggtttttggcgggacacccatatgaaagtcgaaggagaaatcgttcagacgctccacagcatttttatgcttgattgggaatacgtttcggatgaggtgctgattgatcagaaagcatacagccgcccggtccctgcagaaagcggcggcgtctatcaagtcgttccgacgggccccgatatgaaggagcggatgagcgatctgtattatgccatgatagcggcggccgaatcatctgtatggatcgcgacgccttatttcgtgccgaatgagccgatccgcacagcgctaaaggaggctgctgccagaggcgtccgggtgcgagtcatggtgccggaaaccaatgacggatttttaacccagtacgcgacgagatcgtatttccccgagcttcttcgcgaaggaatcgaagtctattcctatcaaaaaggctttatgcatcaaaaggtgctcatcactgacggaaacctcgcctctgtcgggacggcgaacatggacatgagaagctttcagctgaactttgaggtcaatgtcttttttacagatcaaaaggcgatcaaagatcttgaagcgcattatctggaggatatgagagagtctgagaaaatcagccccgtccgtttctataagcgcacattatgggaaagaacgaaggaatccttcgcgcggttattttccggcgttttataaaaaacgcttttaaaactccttgtgtatagtataattgagaaatattatcattaggaacgaggcacaaggaggacggaaacgtgctgcgacaatttttttcttattataaaccgtacaagaagctgttttttctcgacttcttttctgccatcgccggcggattgatggagctgagttttcctctgattgttaattactttatcgatacattgctcccgggcgggattggcgtctgattattttgacttccgctgctttattcggagtctacgccctcagctcggcgcttcagtatgttgtgacgtattggggccatatgctcggcattaacattgaaaccgatatgcgtaaaaagctttttgaccatctgcaaaagctttcgttcaaattttacgataacaacaaaacgggcagtttaatgtccaagctcaccaatgatttgatgtatatcggagaaaccgcccaccacgggcctgaagacctgtttatcgcggtcatgacgattttgggcgcgttcggtgtgatgctgttcattaactggcagctcgcgctgttgacctttatcattatgccggtcgtcatttggcttgctttgtatttcaataaaaaaatgacctctgcgtttacaaaactgaacaaagacgtcggagacttcagcgcgagggtcgaaaacaatatcggcggcatccgtcttgttcaggctttcagcaatgaagcgtttgaaacgcagcggtttgacgtgaacaatcagcgtttccgcaaaacaaagctgacgtcatataaaatcatggcgaaaaacggctcgatcagttacatgctgacaagattcgtcacgctgttcgtcctgttgtgcgggacatggttcgtgatccgcggatcgttatcttacggggaattcgtcgcttttgtgctgctgacgaacgttctgttccgtccgattgataaaatcaacgcaattattgagctgtatccgagaggcatagccggttttaaaagctttatagaaataatggaaacggagcctgatatcaaggacgccccgaacgcgagacatgtgtccggtttaaaagggaatatccgttatgatggtgtgtcattcggttacgaagaaaacagcccggttctgtcgggaatcaatttgtccattcatgcaggggagacagtcgcattcgttgggccttcgggagccggaaaatcaacgctgacaagtctgctgccgcgtttttatgatccgtctgaaggcgtgatttccatcgatggaattgatattaaggacatgacgctgtcatcattgcgcggacaaatcggcgtcgtccagcaggatgtctttctgttttccggcacattgcgggaaaacattgcgtacgggcggctcgatgcgtctgaggaagaaatccggcaggccgtccgccaggcgcatttagaggagctggtaaacgggtatcccgacggtttaaacacggtgatcggcgagcgcggcgtgaagctgtcaggcgggcagaagcagcggctttccatcgccagaatgtttttgaaaaacccgtcgatcttaattttagacgaggctacatcagccctcgatacagaaacggaagccgccattcaaaaatcgctgcaagagctgtctgaaggacgcacgacgcttgtgatcgcccatcggctggctacgattaaggatgcggacaggatcgtcgtcgtcacgaaagaaggcatcgctgaacaaggtcatcataaggaactgctggcatccggcggcatataccagagactccatcaggcccaattcggcgagctgatacatgaataatggaaaaaggatagacgagcgggggccgggcagcctcctgtctatccttttttttatgtagtccgtatttaatgggcttctttttgcgcaggttcgatgatatgtttgaaacggtcaacaagctgcaccgctttctttccttccactacaattaaatattcttgttctttatgagccattctgaacgtttccagctcaatgatatctttgattttgcacattgtttttttagagtagatatacagctcgtggcctcccgtgtggcaaagctgataaagctgaagcatgtttcttaaagtgaacttcttagcggctattttcaaagatgtaatgtttttcatgtgttttctcctccgtctgatggtctgttatttcggaaattccccatatgaacgggtgataaacctggttatgccttccacctcagcactccgcccgccaggcgtttaactccgcggatggcgcttaattcttcgacgagccggagcagcgcccggtctttctctttcgcctcaatcataaaatcgatgcccgcatcccattgtctgaaccgctccagcaccggcagaataaaattcgcgtccacatagtccgcatgactgcgtacggctgattctgattttggcgaggagagatggaccttcggctttaagccgatccgctgccatgttttgatcatccgcggaagaatgtcatctaaatcagcgtcatcggccggattggcgtaaaaatggtgataatcaaacacaaacggaatgccttcttgctcacatacactgagtgtttcctcggacgtatatgttttatcatcgttttctaaagtcatccgctgtttgatgacttcgggaagttctttcagattcacgcggaaacggccaagcgcgctttgtttgtcaccgtaagcgcctccgacatggatgttgatgacggaacggtccgcgatgcccattgcgtccagcatgtcataatgataggccatatccttgaccgcatttgcggtaatctcccgtttcgggcttgtaaaaagcgtgaattggttcggatgaaagctcgttctgaggtcatattttctgaccagcccgccgatctcacgaaactcctggcgaaacggcgtgacaaaatcccacagtacatccgggtgcgtggcgagcggcacaattgagcttgagaacctgtacaaagggatgccgtggccgaccacatagtggagggtgcgcagcgtattggtaagatttgctttcgtcacagaaagcagagcgtctttccgctcactgcgggaaagcttggtatagcgcgcatatgttaaggttttggcgggggacgcgtcccaaaggcacatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcctcatcatgaatgatgacatttacctcttcattccagaacaggctccgtttatcaaaattcggcgtgccgataatgctgatgcggtcatctataatgaaggctttaacatgataaaagccttgataataccgatagatgaggcagccggccttcaggagctcgggataataggtaaaagctgtttcccgaacgagcgggtgatctgatttcatcggaacgatcaagatgactttgacgccttttcggcaggctgaaataagcgcttcctgaagctttttgctcggtacataataaggcgtgccgatgatgatttttttctccgccttacggatgcagttttcataatgcgattcaagcgaaaaaccgtcagatgcatatgtcctatgagagatattcccttcggataatgccggataaaccccgggtgattcgggtgtttttccggtgtttcgtttcaggtcgcttacaaaaagagtctgaagatctgccgtgccttcgccggtcatccgcaggtgataatcctcccagtttccgaacttcgctttttttccgaggtactcttcagcgatattaaagccgcccacatagccgattttgccgtcaatgacggtcactttccggtgattccgtttttgcagcctgaaaaaaagaaagggaaatgccggtttatttagaaaatgaacgtgaacgccggcttttttcatcgtttgaatggaaggctttttcacttggcggctgcccgcccaatcgagcagcagatatacggagacgccggcccgggccttttctttcaataaatcaaacatctcatggctgacttggtcgttcttcataataaaaaacatcatatgaatagaagagacggcttggcggatatcagccgtcatctgctgcacaagctcgctgccgcagtgaatgagtgtgatatcactttttttggggtcaaaaacgggctcatacgcctgttttttgtacgccgcccggccaagcagcatatcaagcagcataagtgcgatcaatatgataaaaatgacaagcaacacaaaaatgaccttcataccgacgctcctttccgaagtatccgtagtgtgccctgagaatgtgaatttaattattgactgaacactcattcattatttatgataaagtaaagatatgacaatgaagaggggaatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacagaaaaaattgctgaaagataaaaagagcggaatcatccacgttctgtttttttacggttttatactcgttcagttcggcgcaattgattttattctgaaagggctgcttcctgaccggcatctgccgttcggcccgctttatccggcatttaccttttttcaggaaatcgtcacgtttctgattttaatcgccgtagtctgggcgttttaccggcgctacattgaaaagctcgtcagattgaaacgcgggtttaaagcggggcttgtcctgctgtttatcggcggactgatggtgacggtgctgctcgggaacgccatgaaccttttatggcacgatcattctctgtcttggacggaaccgatcgcttcctccattgcgtttgtgctcggcggtctttcagcgccggcggccgccgccgtgttttatgtttcatggtggcttcatctgttgtttttgctcagctttttagtgtacgtgccgcaatcaaagcatgcgcacttaattgcgggtccggcgaatgtgttcctcagcaggctggattcaaaaggaaagctggaaaaaatcgattttaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacatcaaaatctccgtgggtgcccgcgcccgtttttcagcacacgaaggcgaatcagctcgccgcggcttcctcagggggaggatcgcgtgaagcggcggcagccattgattacaacccgagcttaatcggcgaggtcatcacggaagaggagatttgggcgtgcaccacttgccgcaactgtgaagatcaatgtccggtcatgaatgaacacgttgataaaattatcgatctgcgccgctatcttgtgcttacggaagggaagatggacagcgacgcgcagcgggccatgacaagcattgaaagacagggaaacccgtggggcttaaaccggaaagagcgggagaactggcgggagcaggctgatacagagattccgacagtgaaagaaatgaaaaaacaagacaaagagttcgactatttgttttgggtcggctcaatgggttcctacgacaacaggagccaaaagattgccgtttcatttgcaaagctgctcaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacggaatcaaaaaaatcgtcacaattgatccgcacgcctataatatgttcaaaaatgaataccctgatttcggattccgggccgaagtctatcatcatactgaattattagccgagcttgtgtcacaggggaaactaaaaccgcttcacccggtcaatgaaacgattaccttccatgactcgtgctatttaggaagatacaacgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgaggatcaacacggcccggactgagcaggcgctttctgtcagtccgacggtcatcagctccggatgtccttactgtctgaccatgctcggtgacgggacgaaagcgaaagaagccgaagacgcgatcggcacttatgatgtcagtgaattgctcgccatgtctgtattcggcgccgaaaaacaagagtctttatagaaagaagcgggccgccggcgcatatgccggcggctttgttttcgcacatcagccgatttatgaaggggcggctctaaaatttcttaaattacgctgtttagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttactcggtgttacgaaagaggaactgggcgaccgtatcgcccaattttatacagacctcaacattgacggccgctttattgctctgtcagatcagacatgggggctccgcagctggtatccgtacgatcagctggacgaagaaacacagccgactgtaaaagcgaaaaagaaaaaagcgaaaaaagccgttgaggaagatctcgaccttgatgaattcgaggaagttgatgaagatgacatcgatctcgatgaaatggaagaagatattgaccttgacgcagacagctttgacgacgaagatatcgatgaagaagatgacgacgagcttgagattgaagatgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggcagcatcacttggccgccttttgaaaaacagaggcatgagcgtcaccatccaaaaatttgacccttatatcaacgttgacccgggaacgatgagcccgtaccagcacggtgaggtattcgttaccgatgacggcgctgagactgaccttgacttagggcattatgagcggttcattgacattaatctgaacagattcagcaacgtgacgacaggtaaaatctattctgccgtattgaaaaaagagcgccgcggggactacctcggcggaacggttcaggtcattccgcacatcacaaatgaactgaaagaccgtgtgtaccgtgcaggcaaagaaacaaacgcagatgtagtcattactgagatcggcggaacagtgggagacatcgaatctcttccgttccttgaagccatccgtcaaatgaaaagcgacatcggccatgaaaacgtgatgtacattcactgtacgcttgttccgtacatcaaagcggcgggcgagctgaaaacaaaaccgacgcagcacagcgtaaaagagctgagaagcctcggtattcagcctaatatcatcgttgtgcgcacggaaatgccgatttctcaagatatgaaagataaaattgcgctcttctgcgatattgacacgaaagcggtcatcgagtgtgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagccttgtcggtaaatacgtcgagcttcaggacgcttacatttcagtcgttgaatcactgcgccacgcgggctatgcgtttgacgctgatgtgaagatcaaatggattaacgccgaagaagtgacagaaagcaatattcaagagctgactggcggcacagacggaatcatcgtgcccggcggtttcggggaccgcggcgtagaagggaaaatcatcgccgccaagtatgcgcgtgagaataaaattccgttcttcggcatctgcctcgggatgcagattgcatccattgaatatgcgcgaaacgtattaggtctggaaggggctcactctgcggagatcgatccgtccactccttatccgatcatcgaccttctgccagaacaaaaagatgtcgaggatcttggaggaacgcttcgtctcggactgtacccttgtaagcttcaggaagacacgaaagccttcgaagcgtattcggatgaagtggtatacgaacgccaccgccaccgttatgaattcaacaacgaatacagacagcaaatggaagagaacggttttgtgttctcaggaacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagcggcaagtcttttttctgcatcaggcatattcctgcatcatttcctttaacgtaaaggacagcgcgtgatagacatacaggcctgtcattaatgaaggaaagccgtatcttgtcccgtcttcatcgggcagaagcggcatttttaatttgctgtcaatatgaacatcacaaaattcctcaatcccggtttgatctttgatgacaggagatacgcaaacgaggccgacccctttttcataaagcttttgagccagcgcctgttcttcagccgtgcccggacctgaacaaaacatcagcaccctgtcgctttctgtaatcgaatcagctgtatccggaaacgctttgacagaaggcatcggttctgagccgagttccgcctcgcacaaaatgccctgcatctcatttgcgccgtataaataaatggtatgaccgctgacggctgcctgcgccagcaggcgcgcgccgtcttctattgcatcggactccttatcctgaatgcgggaaaaaatgcctgcaagctgcgtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgttccataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgatcgacgaatccatccgcgtcattatcatgaccgcttacggagaactcgatatgattaaggaatcaaaagagctcggagcgctgactcattttgcgaaaccttttgacattgatgagatcagagacgcggtgaaaaaatatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctacataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgcgattcacttagaccacggttcaagctttgaatcttgtgcgaaagcgattcatgcaggtttcacttctgtaatgatcgacgcatctcaccatccgtttgaggaaaacgtagcaactacagctaaagtggttgagcttgctcatttccacggcgtttcagttgaagctgagcttggaactgtaggcggacaggaagatgacgtgatcgctgaaggcgtaatctatgctgaccctaaagagtgtcaagaacttgtagagcgcactggcatcgactgccttgcacctgcactgggttctgttcacggcccttacaaaggcgaaccgaacctcggtttcaaagaaatggaagatatcggcaaatcaaccggccttccgttagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagaaatgattgaagaaggtaaagaacttgcgaaaatcgcgccgaatattacggtgaaaatcccgatgacgtctgaagggttaaaagccgtaaaagcgctgagcgacctgaacattaaaacaaacgtaacgctcattttcagcgccaaccaggcgcttttggcggcaagagccggggcgacttatgtatctccgttcttaggccgtctggatgacatcggccataacggtcttgaactgatttcagaaataagacagatttttgacattcatgacattgatactcaaatcatcgcagcttccatccgtcatgcgcagcacgtgactgaagccgctttacgcggtgcgcatatcggtacgatgccgctgaaagtcattcaccagctgacgaaacatccgttaacggataaaggcatcgagcaattcttggctgactggaataaataagggggaaaagggcggcaaaccggttgcatccgtttgccgcacccttatgttttcctgtttggcagcgggccttcagtatcaaagtgaagagtgtgtttccccggaatatgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttacgctccgcagctatcttcttatggaaggagactatcatggaaaagttgaatattgccggcggcgatccgttaaacggaaccgtacatatcagcggtgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgttgacccttccccgatgatcagcatgccgcttcccaacggcaaagtgaaaaaactccgcgcttcctattacttaatgggcgcgatgctcggccgcttcaaacaggcggtcatcggactgccgggcggatgccatctcggtccgcggccgattgaccagcatatcaaagggtttgaggcgcttggagcggaagtcaccaatgaacaaggcgcgatttatctgcgcgccgaaaggctgagaggcgcacggatttatttagatgtcgtcagcgtcggagcgacgattaatatcatgcttgccgctgtactggctgaaggtaaaaccgtgatagaaaacgccgccaaggaacctgagattattgatgttgccacattgctcaccagcatgggcgcaaagatcaaaggtgcgggaaccaatgtaatcagaatcgacggcgtaaaagagctgcacggatgcaggcatacgatcattccggacagaattgaggcgggcacctttatgatcgccggcgccgcgatggggaaagaagtcattattgataatgtcataccgactcacctggagtctttaacggcgaagctcagggaaatgggtttttacattgagacgagtgacgatcagcttcttatgctcggcgggcagaagcagataaaaccggtcgacgtgaaaacgcttgtttacccgggattcccgactgatcttcagcagccgatgacatctctgttaacgagagccagcggcacgagcgtcgtaaccgacaccatctactcggcccgatttaaacatattgatgagctgagacggatgggggccaatatgaaagtggaaggcaggtcggccattatcaccggtccggccgagcttcagggcgcaaaagtaaaggcgagcgatctgcgtgcaggcgcttgtctggtcgtcgccgggctcatggctgacggcgtaaccgaaattaccggtcttgagcatttagaccgcggctacagcaatcttgagaaaaaactcgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagcttggaaacggatacggcccgcgcgtcgatgtcgccgtcgatcctcttgaaggcacaaacatcgtagcgagcggcggctggaatgcgctgacggtgatcgcggtcgccgaccatggaacattgctgaacgccccggatatgtatatggaaaaaatcgcggtcggtcccgaagcggtaggctgcatcgatatcgaagcgcctgtcattgataacttaaaagccgttgcgaaagcgaaaaacaaagacattgaagatgtcgtggcaaccattttaaatcgtgacagacacgaaaaaatcatctctgaattgcgtgaggcgggcgccagaatcaaactgatcaacgacggtgatgtcgcgggcgccatcaatacggcctttgaccatacgggagtagacattctcttcggttcaggcggggctcctgaaggcgtgctgtctgccgttgcgttaaaagcgctcggcggcgaaatcatcggcaggcttctgccgcaaagtgcggaagagcaggcccgctgtgagcgaatgggccttgatgtatccaaagtgctccggatggaggaccttgtgagaggggatgacgccatttttgccgcaacgggtgtcacggacggagagctgctgaaaggcgttcagttcaaaggctccgtcggcacgactgaaagcctggtcatccgggcgaaatcaggaacggtccgattcgttgacggaagacacagcctgaagaaaaaaccaaatcttgtgatccggccataaatagagaaaagcgggacggaaagtcccgcttttcttttgcaaaaaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccatcctgaaagccaacgccgagcaggaggatcttctgtttatggaaggcgtgctcgaaatcatccaatcggaaggattcggcttcctcagaccgattaattactcgccaagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaagagcgcgttcattttcctgcgctgactccgctttatccggaccgccaaatggtgcttgagacgaaaccgaactatctctcaacaagaattctcgatatgatggctcccgtcggtttcggccagcgcggtctgatcgtggcgccgccgaaagccggtaaaaccatgctgttaaaagaaatcgctaacagcattacgacaaatcagcctgacgctgaattgatcgtgctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcgggattgacccggctgcgttccatcgtccgaagcgctttttcggtgccgcgagaaacattgaagagggcggcagcctgaccattttggcgacggcgctcgtagacacgggctcccggatggatgacgtcatctatgaagagtttaaaggaacgggcaacatggagcttcaccttgaccgttctcttgcggaaagacggattttcccggcgatcgatatccgccgctccggcacgcggaaggaagagctgctcgtgccgaaagagcatcttgaccgtctatgggcgatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattcgctccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacatatgcgaagcaggaggtcaaggtgttcaaacctgccattgataatcgctacagtgaggaggctgtcgtttctcacaacggcacatccatgacaagccacgtcatctcgtcttcggctgaaatatgggatcatatcagtgaaagcacggacgtcatcgcggtagatgaagtgcagtttttcggcgaatcaatcatcggcgatttatccttgcttgcggataaaggctatcgtgtcatcgcggccggacttgatatggatttccggggagagccgttcggtgtggtgccgaatctgatggcggttgccgaatcagtgacgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcaccacgaagtgctgaaaaaacagactgataaataacccttttcatgaaaacatcggtaaaaaatccggtgtttttttgacggtttttcaaaaattgtagttaattaacttaaaaaagagtatgaaaaaattaagtaattttcatctcttgaattttcatttttacaggcataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgaccattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaatgtagaaggaatcgaagaggcatttgaaaaccttcatgccactgccggagatattgatctgatcgttgcgacagactcagaaagcatcctcggaatcggtgactggggtgtaggcggtatcaacatcgccatcggtaaattagccgtatacacagctgctgccggtattgacccaagccgtgttattcctgtcgttcttgacgtcggtacgaacaacgaaaaacttctgaacgatcctttatacatcggtaaccgccatgaacgtatccaaggcgaacgttatgaagctttcattgacgcttatgtaaaagctgcgcttaaatatttccctaaagctcttcttcactgggaagaccttggaaacaaaaacgcgcgcaatatcatgaagaaatacaatcatgaaattcttacattcaacgatgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatctattcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgagaatgtagaacaagccgttcttgatgcaatgtggaaaccgcaatataaacaagttatcgctaaataatttttacgattaattttacagtccgagggaaagcttttatgtaaaggctaaagtatacggacattaaggatttggaggagaatattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgcaagtattttaaccacttcaagaagtgcgtttttatcacaggttcctttaatgatcgctttgatcattgggattgtcggattctttatcgtcattttgttggtttgcaaatttatcttcaagtatgatttaacgaattcatctgtattttctttaaactctgcacagccgacatttgcatttatgggtattccggtactcggaagcttattcggagcaaacgaagtagcgattcctatcgccgttacgggtatcgtggttaacgccatccttgacccgcttgcgatcattatcgctacagtcggtgagtcatctaagaaacaagacagcgaaaacgagaacttctggaaaatgactggtaagtctattcttcacggtctttccgaaccgcttgcggctgcaccgcttatcagtatcatcctggtactctgcggtgtaacactccctggcttgggtgaaaaaatgcttgatcagctcggaagcacaacatcaggtgttgcactctttgccgtcggtgtaactgtcggtatccgcaacatcaagctcagtctgccggctttcggtatcgctttgttaaaagttgccgttcagcctgcgctgatgtacttgatcgctcttgcagtcggacttccggctgaccagatcactaaagcggtattgctcgtcgcattccctggatctgcggtagcggcgatgattgccacacgtttcgaaaaacaagaggaagaaactgcgtccgcgttcgtgatcagtgcgattttatctcttatctcactgccgatcatcattgcgctgactgcataatgaaaagctccctgtttcagggagcttttttgattagaattgaaatttaaaaggcgaaaatctcgttttttttctgggtttcttatgttctgaagaagcggctgtttctgagaggggagctgtctgggcaagttcctggatgcgggaggccaatgtctgcaattcggtattgaggtcgtcaatttcccgtctgtgctgaagaagctgataagacaccccttcatccgccttttgtttcagctggcgttcaagctcctctatccttgaaagcagatggttctcatcctgtttctctttcgtgagaatgtccagtttgcgctccagctctgccaacctttgttcagcgccgccattgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgcttgacccacctttgcaccgtttttgcggagacgccgagctctttcgcggccatgtttgtattcatgatcacatacctcctttttgctaggtattcgaccatgaggcggcgttcccttcatgttagacaaaacaagaaggaattcgccaaagaaagcggcatttcttcaaaaaacgttacgcttcatacaattcaagcggaagcttgtcgggatcgaagaaaaaggtaaaccgtttccccgtcagcggatcggttctgatcggttctgtgccgacgccctttttctttaactccctgacggctgcttcaagatcgtttacggtgaaggcgagatgccggagacccgcggcttccggtctggtcggccgttcgggcggatcgggaaaggaaaacaattcaatcgcatacgcgccgtccagcgccagatcgagtttataagattcccgttcctttcggtatgtttcttttataatgccgaaaccgagtatctcggtgtaaaaagctttcgacttttcataatcagagcatatgattgctatatggtggatggatttcagcatatccgcccctccttttttgcttcagtataacagaggcgaattgcttttgactggtgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgacaaaaacgtaatcatggagatccgcggagcagcgggaggagaagaagccgcgctgtttgcgggaaatctctacagaatgtactcccgttacgctgaaatccaaggctggaagactgaagtcatggaagcaaacgtgaccggaacgggcggttacaaagaaatcatctttatgattacgggaaaaggcgcatactccaagctgaagtatgaaaatggcgcgcaccgcgtacagcgtgtgccggaaacggaatcaggcggccgtattcatacatccacggcgacggtggcgtgtcttcctgaagcggaagaagtagaagtggacatccacgaaaaagacatccgcgtcgatacattcgcatcaagcggaccgggcggacaaagcgtaaatacgacgatgtcggccgtacgcctgacgcatttaccgaccggtgtcgtcgtatcctgtcaggatgaaaaatctcagattaaaaataaagaaaaagcgatgaaggtgctccgcgccagaatctatgacaaattccagcaggaagctcaggctgaatatgatcagacccgtaaatcagccgtcggatcaggcgaccgttccgagcgtatccgcacatacaatttcccgcaaaaccgtgtgacggatcaccgtatcggcctgacgattcaaaagctggatcaaatcctggaaggcaagcttgatgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgctgttaaatgataccggaatggatcggagcaagcttctcgcaagtctgcaggagcccgtcggcgaggacgagctttaccgattcagacggcatgtggaaatgcataaagaaggcgttccgattcaatatattatcgggaaagaacagttttacggcagagaattctttgtgaatgacgatgttctcattccgcgtccggaaacggaagaagtcgtctttcatctgctggacagacagaagcgggtgttttctgagggagaacgcctgaacgtcattgatatcggtacggggagcggagccattgcggtgacgctcgcgcttgaatgcggacatttttcagtatcggcttcggacatttcaaaagaagcgcttcaggtggcggaaagaaatgcgcaaaacctcggagcggacgtccgctttttgcagggagatctgttaactccttttatttcatcaggaataaaagcggatattattgtttccaatccgccgtatatttctgaagaagaaatggcggatttgtcggatatcgtccgtttccatgagccgcttcatgcacttacggacggcggtgacggtttgaaattctacaagcggtttatggaggagctgcctcttgtcatgaaagataaagcgcttgtcgtctttgaaatcggatataatcagggaaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggctggatttgtcctgccgtttggctttgacatcattctcggcgccgttacggctgttcttatcgtcgcagcggtcatcgtttccgggctggccgtaagcggagcggagcagcgggccaattatcattctgaaacagaagaaggacggcgcgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaacgacacccccaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaagcacggagaggaacggtggggaccgatgaaacagacaatgatgatctgcatatatatttttcttttattatcaggagcgcttgcgggtttgacaaaagaagaaacggcgcgggcatcagccgatgagcccgtcgtcataccggatgaagcgatccggctcaggattttggccaacagtgataacgatgaggatcaaaagctcaagcgccagatcagagatgctgtaaacaagcaaatcacggactgggtgaaagatatcacttccattgaagaagcgcggcggctcattcgttcgaagcttcctgaaattaaagaaatcgccaaacaaacgatgaaagaaaagggtgcgcatcaatccgtttcagttcaattcaataaaatctcgtttccgacaaagctgtacggcaatatggtctatccggccggaaaatatgaagccattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagacagaaaaagtgctggatgacgtaaaagcaaaggccgataaagcgaagaaagaaaataaagatgacgatgataccgaagtgaagtttttcctcgtcgattggatttcagatctattttcctgaagcaaaaggcataaatccggattcgattcatagattggaagaaagagttgatcgaaacggagggaaatatatgttttatcagctgagagtggcaagagatcaagatacggaggcgctggaggcctttttgaaaaagtctgatacggcacatgcggaaatcgatcagcagatcagccggtttatcgtgctggaagacagcgaaaaaaagattgccgcctgtctcgggatcgaaaaattcagcggcggaaaagggcttctccgttcactcgtcatgtcggacaggctgaatcaaagccatatcgttacactgtttcaaagtatggatgtgctgtgcaaaaaacatgaaattcaagatgtctacttagtcgccaatcagccctcatctgctgagtttctgaatgtgatgggatttgaagcgtgcgccgatgcgcctgaggaactgtatacgtccgaacatttccgcaactcgttatgcacagaaggttcgtttttaatggtgaaaacctctgcctgatctaacttatacacaaggttatccacttattaaaaagtgttgtccacagtttgtggataacgcttgttttattaaaggacatcttttatactttcaaaaggaatacacgagagaaaataaagttttaccgctttaaaataaggagtttggttatacatgaaaacaagaagatggtttgtggattgttccgcagaattatccacaaccgatccccaaattacacaagccgcggaattgctccggcagaatgaggttgtggcttttccgacagaaaccgtttacggactgggcgctaacgctgaaaatacggaagccgtaacgaaaatatatgaggcgaaaggaaggccgagcgataacccgctgattgtgcatatatcccatatcagccagcttgatcgttttatcagccatattcctgagacggcgaaaaagcttatggagctattctggccggggcgctgacccttgtcctgccgtgtaagcccggtgtgctgtcaccccgtgtcaccgcgggactggagacggtagcggtcagaatgcctgatcatccggcagcattagccctcatcagctcggccggactgccgatcgccgcgccgagcgccaatttatcaggaaaaccgagcccgacgaaggccgagcatgtagctcatgatttaaacggccgtattgccggtattgtggacggcggcgcgacgggaatcggagtggaatcaaccgttctgtcctgtacggggaaacagcccgtgctgcttcgtccgggcggcgtgacaaaagagcagattgaatccgccgccggtccggttcttgtggataaaggactgaccgaagaagatgaggttcctatttctcccggtatgaaatatacacattacgcgccttctgcgccgatggctattgccgacggcggcgcccggagaattcaagaactggcagacgcatataaaagccggggaaaacgaatcggcattttgacaacagaagagaacgccgatagttaccaggctgattatatcaaggtctgcggcagacgcgccgaccttgaaacagtggcgtccgccttatacgatgcgctccgcagctttgatgaagcggaagtggatatgattatttctgagtcctttccggataccggagtggggctcgccgttatgaacaggctgatgaaagccgcaggcggcaccgttatccattaacttgttctaccccttatcggacatgcataagctaaacaagcgggcacgtccaaggggtttttattcatgtcgaatctattcatcggggaacttgtctccttaagcatcatggcatttgctttggggacggatgccttttccgtcgggctcggaatgggaatgattcagctgaagaaaaaacagatttttcatataggggttgtcatcgggctgtttcatgtcatgatgccgcttgtaggaatggcggccgggcatctgctgtccggttttctggggatgctcgccgtttacatcggcggatctcttcttttcattttaggggtgcagatgatgatcgccgcgtttaaacaatcggacgggccgctcatatctccggcaggctcgggactgttgctgtttgcggtcggtgtcagtctggacagcttttctgtcgggctcagtctcgggatgaacggctccaatccgtttctggccgttacgctgttcggggtcttcagcaccgttttaacatgggcgggccttttggcgggaagaaaggtgcagtcatggctcggctcctacagcgaagcgcttggcggagccattttgatcggattcgggctgaaactgcttttaccgatataagatacgtaaaaaaagaaacgaagatgccgtttcttttttcttcatttataataggtagtaagaggtgacggacatgaaaataatctttgtttgtacaggcaatacgtgccgcagtcccatggctgaggctctttttaaatccatagcagaaacgaaagggctggatgtcagcgtaagctcggccggcgtattcgcgtctccgcacggaaaagcgtcggctcatgccgtagaagcgctgtttgaaaaacggatcgccctcaatcacagttcatctcccttatcggaagaacatatcgagacggccgatctggtgctggcgatgaccgaacagcataaacagctgattgaaggccgatatcaaaacagtcagggcaaagtttttaccattaaagaatacgtgacgggggaaagcggcgatatctctgacccgttcggcggtccgcttgatgtttataaacagacgcgggacgaactggaggagctgctgacccttttggctgatcaattgcttgacgggaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggacggcagtctgctggtggtcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaggctccccattgtttcagccgtccccgtcccgaaagcgggcggagcgatggcctcttatgcataccggcagatgcgttctccagtgctcgctgaatcgattcaggctgacgccgggattgacatcggtgatacgttcatcggcatgcatctgaaacccgttgccgtccctgtccggatatcgagccgtgagcttggagaagcacatgtgacgatggcccggacaagaccgaagctgataggcggaattcgcgccgtatatgaatgcgaatgatgaaaatacttttcctctataatgttcgtgttttctaattaaattttgtgatttttttaaataagctgttacattcacctgaaaaaccatgtacaataaggtggtaaaaataaagaacaggaaacggataggagaggatctcgctgatgaaacatttacctgtacaagataaacaagtgtttaacgccatcaaagatgagcgtaagcgtcaacagactaagatcgaattaattgcttctgaaaacttcgtgacggaagcggtaatggaagcacaaggctctgttttaacaaacaaatatgctgaaggctaccccggcaaacgctactacggcggctgtgagcatgttgatgtcgttgaggacatcgcccgcgaccgcgcgaaagagattttcggagctgagcatgtaaacgttcagccgcactcaggcgctcaggcgaacatggctgtttacttcacgattttagagcacggcgacacggtgctcgggatgaacctctcccacggcggccacttaacacacggaagcccggttaatttcagcggcgttcaatacaactttgtagaatacggtgtcgataaagacacgcaatatatagattatgaagatgtgcgtgaaaaagcgctggcgcataagccgaaactcatcgttgccggagcgagcgcatacccccgcacgatcgactttaaaaaattccgtgaaatcgctgatgaagtcggcgcttacttcatggtagacatggcgcatatcgcgggtcttgtcgcagccggccttcatccgaatccggttccttacgctgactttgtaacgacaacgactcacaaaacacttcgcggaccccgcggaggaatgatcctttgccgtgaagagttcggcaagaagattgataaatccattttcccgggaatccaaggcggaccgcttatgcatgtcatcgcggcaaaagccgtttctttcggagaagtgcttgaagatgatttcaaaacatatgcgcaaaacgtcatctcgaacgcgaagcgcctggctgagtctctgaacaaagagggtattcagctcgtatcaggcggaacggataaccaccttgtgcttgtcgacctccgttctctcggactgaccggaaaagtcgctgaacacgttcttgatgaaatcggcattacatctaataaaaacgcgatcccttacgatccggaaaaaccgttcgtcacaagcggaatccgtctcggtacggcggctgtgacaagccgcggctttgacggtgacgcgcttgaagaagtcggcgccatcatcggcctcgcgctgaaaaatcatgaagacgaagcaaaacttgaagaagcgaaacagcgcgtatctgccttgactgaaaagtttcctttatataaagaactggactattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagaccttgtggatgaagtcgcatcactgatggcgtttgaaattacacgtgatcttcctcttaaagaagtggaagtgaaaacacctgttcaaacagcgacatccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggctctgcggtggaagcgatcaacagcctgaaaaagcgcggcgcgagaaacattcgttttatgtgtcttgtagcggctccggaaggcgtggaagagctgcagaaacatcattctgacgttgatatttatatcgccgcccttgatgaaaaactgaatgaaaaaggctatatcgttccgggcctcggtgacgcgggtgacagactgtacggaaccaaataaatcggaaaacctcattcaggggttttcttttttttatccagattttagctgaatgggcagaggtcatacatttataggtgaatttgtgaacattctgtgtatgcttccggtataaaaagttttttaactttaaacagattgacacatgttaggggctattgtatgctaaacgagggtattatgagaaggttttcattcctttcatttctagtatccatcctcattttaaatcctccaaaaaaacccgttatatgaggatttatctaagcgaatgaaacagcatcccgtagcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaatatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattcttactacaagaacgctgtccatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctagggctgccgttttctgtaacggtcggacacgagctttggtggaaatcaccgacggctgatccggctattactctgactctagccgttatggttgtgtcgttaacgcactattacggcgtgaagatgaaaggtttgaaggaatactctaaggattacctcagaccggttccgcttatgttcccgatgaagatcattgaggagtttgcgaatacgctgacactcggacttcgtctttacggtaacattttcgccggggaaattcttcttggcctgcttgcgaatctggcgacgaatttctactcaaacagtttctttctcggtttggtcggcacagtcggagccattattccgatgcttgcatggcaggcattcagcttgttcatcggtaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggtgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccgaaacggctttttatcagcagagaaaacctgcagaagggagttgccgtagtagatgtctcaattacctcttgaattaggactgtcgtttaacggcggagatatcctattccaattgttagctatgttagttttattagcgcttctcaagaaattcgctctgggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaatcactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccgaaacgaagccggattacaggaagtgctaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggacgcggttgtttattcagtaaagccgctttcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtaagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtacacggccttgacaattgtatggccggtgaacttgttgagttttcaaacggcgttttgggtatggctcaaaaccttgaagaatccaacgtaggtatcgttatcttaggaccttacagagatatccgcgaaggtgatgaggtcaaaagaacgggccgcatcatggaagttcctgtaggtgaagaattaatcggacgtatcgtcaacccgctcggacagccggtagacggactgggtccgattctgacaagcaaaacacgtccgatcgaaagccaggctccaggcgtaatggaccgtaaatcggtacatgagccgctgcaaacgggtatcaaagcgatcgacgcgttaattccgatcggccgcggacagcgtgaactgattatcggggatcgtcagacaggtaaaacatctgttgcgattgatacaatcttaaaccaaaaagatcaagacatgatctgtgtgtacgtagcgatcggccaaaaagaatctacagtacgcggcgtggtggaaacacttcgtaagcacggcgcgcttgattacacgattgtcgtgacggcatccgcttcacagccggctccgcttctttaccttgcaccgtatgcaggggtgacaatgggtgaagaattcatgtacaacggcaagcacgttctcgtcgtatatgatgatttatccaaacaagcggccgcttaccgtgagctgtcattgcttcttcgccgtccgccgggccgtgaagcattccctggggatgtattctatcttcactcccgtctgcttgagcgcgcagccaagctgagtgacgctaaaggcgcaggatcaattacggcgctgccgttcgtcgaaacacaagcaggagatatctccgcttatatcccgacaaacgtcatttccattactgacggacagattttccttcaatccgatctattcttctcaggcgtgcgtcctgcgatcaatgccggattatccgtatcccgtgtcggcgggtcagcccaaatcaaagcgatgaaaaaggtagctggaacattgcgtcttgaccttgcttcataccgtgaacttgaagcattcgcccaattcggatctgatcttgaccaggcgactcaggcgaaattgaaccgcggtgcgcgtacagttgaagtgctgaagcaagacttgaataagccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggcttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgggagatgccgattttgtctgagttagtggggcttggcgacgaggtcacttttgctcagattaaagatttgacccgtcagacggttcaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcttacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgactgataatgcgaaagaactcattgattcactttcgctttcatataaccgcgcgcgtcaagcggcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggcgatgatacagtccgtacaattgccatggcatctacggacggaattcagcgcggaatggaagccgttgatacaggtgcgccgatttccgttccagtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacggggattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggtcttcggacagatgaacgagccgccgggcgcacgtatgcgtgtagcactgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactacactgacccggctccggcgacaacgttcgctcacttggatgcaacgactaaccttgagcgtaaattaactgaaatgggtatctaccctgcggttgatccgctggcttccacttcccgcgcgcttgctccggaaattgtcggagaagagcattatgcggtggcgcgtgaagttcagtcaacgcttcagcgttacaaagaacttcaggatattatcgcgattctcggtatggacgaattaggtgaagaagacaagcttgtcgttcaccgcgcacgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcaaaagagatgggtgtagaagtttaatctggtcctaggagggtaaaagcatgaagaccgttaaagtcaatatcgttactcccgacggcccagtatatgatgctgatattgaaatggtgagtgtaagagccgagagcggtgatctcggtatcctgcctggccatattccgaccgtggctccgcttaaaatcggcgctgtccgccttaaaaaagacgggcagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgttacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcgccgtccgtatacggataaggtttgacgacccattcggcatcgtcatgatgtctgatggcgcaatcgatgacatacacactgagcattttctcaaattcgtcaatcggcaggttccaatccgccaaaagcagctcttttatgctgcggaagtaaagagcttccactgccagcaggctgccgggtgaataatcaagagaaatgttgaaaaactgacataattctttcagttcctctgtttgagactgtctataatcatagtagaatgctatcgcttcccactcgtggtcaaatacgggaagtgtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatggaatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgccaacttctttttagattatcttacctattcgaaacagcttccatacttattttaagatgtttcgtctgttgaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgtatcatcttgttttttgtttttttaagcgccttaatagcggtatttcattccattcatgcaagtgagctgtctccgcttgcccagattgccgaaggaatggagcggcagcaggtcactgtggatgaatggacgcttcatgcgaaaaaaaatctgaacctgtcactgagtgaatttgatgacaaggtaaaagaactgaagacgcagtatccgcaatatcattgggaatccgcgcgggaagataaaatcgtaaaggccgtcggcacgtattctgacaaaaaaaatcacacaacttttaaactgcagctcgtcactaccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtctaaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcggaaaacataccgttacggttggcacaccaatcgtgacaactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaattaatgaagtgttgcgtcatttaggagcagatgtgcattttgagaataatgaagttaccgtaaacgcttcttacgctttagaaacagaagcaccttttgaatatgtgcgcaaaatgcgcgcgtcagtgcttgttatgggccctctgttagctcgtacgggtcattcaagagtagcgcttccgggcggttgcgcaatcggctcaagaccgattgatcagcatttaaaaggctttgaagcaatgggtgcaaaaatcaaagtaggcaacggctttattgaagcagaagtggaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcgcggcgtaagacacaacatcattcctgaccgtattgaagcgggtactttcatggtggctgcggctatcacggaaggaaatgtattagtcaaaggtgcggttcctgagcatcttacgtctttaattgcgaaaatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgcgtcacggaactgaagcacttggatcgcggttatgtgaatttccataaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgattttcaaaaaagaatacgtttttcgcgtgaaaaatggaataagattctgtccaaaaggaagtcatattagcttgtccctgcccataagatgaagtagagtcgaatcccaagcaggaggcagctgatatatgaaaccgattgtatttctactatccgggctgtgtatacttattcttcttgttcccaccattctcgttcttccgtttcaggcggaaaaaggagcagccgtaaacagagagcccggacacaaaacaacacacaccacacgagaaacaaaaggagcagaaacattgaaagaatcacctgtatccattccggtttatcggacatccaatcattctgtagagaacattccgcttgaagagtacgtgatcggtgtcgtggcttccgaaatgcccgcaacctttaaaccggaagccttaaaagcccaggcgctcgccgcccggacattcatcgtcagattgatggttgctgactcagccgttcaggcgccgaaaggatcactggtggacgatacgcaaatgttccaagtctatcaaagcaaaagccagctgaaaaaagaatggggttctaagtacgcacacaacctcaagaaaatcacaaacgcggtcgcaggcacgcaaggaaagattttaacgtacgacaacaagccgattgaggcatctttcttctctacgagcaacgggtatacggaaaatgcggaagcctattggacaagcgccattccttatttaaagagcgtgaaaagtccgtgggataagcaatcgccgaaatatcttgccacccagaccttcagtgtgccggagtttcagcaaaagctcggcgtacagctctcgggacaaaacacggtagggcagattacagccagaacgccgggccatcaagtggcgacggccgtcataaacggcaaaaagctgaagggaagagacatccgggaaaaactcggactccgttctgccgactttgaatggaaacggaacggcggcagcatcaccattacgacaaaaggattcggccacggcgtcggcatgagccagtacggggccaattacatggcggagcaggggaaatccgtggcggacatcgtcaagcattattatcagggagtggacatatccgaagcagattcatttttaaacaaatatatggcgaaaaaataggcgctttcatgagcgtctgttttttttgaaaactattccataaacggtaaagcaaccaacagactcatataacgaaagcctaaaggctgacaaatgccgtctgaaggctgagcgccgggtgaaaatcactgataaaaatgccgtatctatgtgaatatacgcaaaaataatgaggaacgccgtcctatttatttcccttttcatctcatttacgataaatattgttcggcgttgaacgtaaatctattgaaaaggggaagaagcaatgaaaaaaacactttcactcataatcatgctcggattgatgctgactgctgcatctcctgcttttgctgccgagaatgcaaacgagaagacatttttatttaaaaacaatatcgccattctgcttgatgcgagcggcagtatggcgaaacggattgacggcgtttctaaatacaatatggcaaaagatgaaatcgtccgttttgcagatcgaattaagtctacatcacaggtcagaatgacggttttcggttcggaaggcaataataaaaactccggaaaagttcaatcttgtgaatccattcgcggtgtatacggattccaaaagtttgacagacagagcttcctcaactctctgaacggaatcgggcctacgggctggacaccgattgcaaaagcattagaagatgcgaaggcttcttttaacggcgttcataaattcggctttaaatccgtttacctgttgacggacggtgaggagacatgcggcggagatcctattaagacagcgaaagaacttcgcaaacatcatattaaagtcaacgtgatcggctttgactttaaagaaggcttcaacggacagcttcacgcaattgccggtgcgggcggaggaaaatattacgaagctcacagccaaaaggatatgaaccgcatctttacgatggaagcgagttcattagcgaaataagaaaaggtgccgtttagcggcccttttttttatttttatttaacaaaaatttcaagaaaagatgaagagaaaactgtaaaaagaatcagattccggacttatattacaaaaagggcgaaaaaggcattaaatctgtcatcatttatccaatctttttaggatgatgcgcataattctgttcatttttaacggcgtacagccgcttatacaaaaggaatcccgccctatatctttttgcatactcctcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgtcgccgtgctgtttgacgcaagcgggagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaacgcgacagaaacgttatacggccttcagccgtacgccgtgactccatttgagcaatcactcagcaagattaaaccgaccggctggacaccgatagcgaaagcgctttctgatacacgtgaagaatttgagcgggccggcgctaaagggaaaaacgtcgtatatctgatcacagacggtgaagaaacatgcggcgggaatcctcaagccgaaattcaaaagctccgtaaagcgaatgtcaacacggtcgtcaatatcatcggcttcaacttcggcatgaaaggaagcgaaagccttgaaaaagcggcggaagcgggaggcggcacatacgtctcagctgacagcgcggacgagttcaaacaggcttgggaagacgccgcaaaggatttagcaaaagaataggttaaaaaaggacgcccgtgcggcgtctttttttgtttagaaaacggaaccgcgggaatgatacggataaaaggagatgaacgctgttgttaaaaggagcaggcattatattggtgctggcggcagtcgtttttgttctgatagggatttttctgaagcttgccgccttcatattcgtcagtatattggccattatcgccgcagttattttattcaccattctgagcagacatcatcgcaatgaaacatagagtccgaagagggctctttttttaaaccgcaaattcgacaaaatacagggattgtggaagaataaaagagaaggatactgcggaggggaaaacagtggatgaaaaaacaacagcggtaagagacatataccgctatgaaaaaggggtattaacaaagacggcagatcggatggtttcagagtatccgcttaccgtcatggtgaacgggcaggaatttgttacgctcgtctgcacgcctgaccatttagaggaactcgtcatcggatttctcgcatcagaaggcgtcattcgttttgaaaaagagatcaaaagctttactatagatgaaagtctcgggttcgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccggattaccataactcctgagacgtgccttcgcctgatgaaggagatgcaaagcggaagcggcaccttccgggaaacgggcggcgtccataatgcagcgctgtgcgatacggaaaagctgctcttgatgaggacggatatcgggcgccacaacgcgctggataagctgtacggctgctgtttgaaaaacggaatgcccgtccgtgacaagctgatcgtcttcagcggccggatttcctcagaggttttattaaaagccgcaaaaatcggcgtgtcgattgtcatttcaaaatcggcgccgacggagctcgcgctgcaaatggcggaagagctgaacatcaccgcgatcggttttgtcagaaacggatcatttaacgtatacacacatcctgaacgggttgaacaatagaaaggggtcttgggcttatgaatacagaaacgcgccgggtgacagacaaaaaggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacgggcggagagccgctcatgagaaaagatatgcctgaattgatcaaaaaacttgcgcgcatcccaggacttaaagatatcgcgatgacgacaaacggctctctgcttcccgtgtatgcggaaaaactgaagcaggcggggctgcatcgagtgacagtcagcctcgattctttagaggatgagcggtttaaggccattaacggccgcggcgtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaaaggtcatattctccggtttattgaatttatggatgtaggcaatacgaatcaatggaataaaaaagacgtgatcacgaaggccgaaattattgatctgatcaaccagcacatgccgacggagccgatagaagcgaattacaaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcgcggatcagtattcaattgaccgcgcgctttctaaaacggatgggaaaaagaaagtggaaatgtcttatataggcggatgaagaaaagcttgcccggacaagggcaggcttttttattcacaatatgagagcggtctgttcaaaaaataccggtaacagccgaaatatatgataggaattttgatgcaggacaatcaagttatgcaattccaaagccatacaatatgttaaaatataaccaatagaaattagaaaaggttgtgaaaggggcatgaccgcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagttttttacgtcatgaagcagactcatttttccatgaatcacgggattcaggcgctggatacgtatatgaaacacgatttttacagagtgcggagaattcaatgccatttcgtcatttcaggaaactacatcgactgcaaaaactacgacaaagcgcttgagcatttagacgaagccctccgcctttctttgcttgaaggacagccccgcctgatcgggtcttcgctttacaatctggggaattgttatgctgaaaagcgggatctggatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagagggatcatgatcgcgaaagaacgcggcgaccgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaaaattcaaaaagaacagtgtttatacgatatataatttttgttaaccatctgatcagcagatggttatttttttatgcacatcaggacgtttgatcatagaaaaaatcggaaaaatcgcaaaagagggaaaaaagtacgatgggaaggagggatttgttgttcggatttaatgatatgataaagtttttcgtttcatttctcatcattctcccgatggtgtctgtcatccatgtgtcgggacacagctttatggccatgctgttcggaggcaaggcgtcgttggatatcggaatggggaaacgtcttttaaaagtagggccgattcaggttcggcgtatctacttcatagattctttctgcaagttcggcgaattgcggatagataaccgtctgacgagcgcgctcgtctattccggaggctgtctgtttaatctcgcttctatctttttaataaatctgctgatcataaaagatttcctagagccaaacttatttttttaccaatttgtctatttttcaacttattatgttttctttgctcttctgcccgtgcaatacggggataataagctgtcagacggattggccgtttacaaagtgatccgctacggggaacgctgtgaaatcaataattgagagttgaaatgtttgctatcaggctgaaagggaagaaaacaagtacacaaaaacaaaaggagctgaagagatcatgagtgaagataacggtttaaaagacaaagtaaaaggcggcatgaacaaaataaaaggggaagcaaaggacaaagcaggcgacatggcaaacaagtccgacttaaaagcggaagggaaaaaagacaaagcgaaaggcagcctgcaaaagggtgtcggtaaaacgaaagataaactcagtgatgattaatttgatcgtgaaacacagcaaaagcccaaaatattttgggctttttgttatgagaaatgacaaaaattccagttcgtttggttaatattcactaaatttttaaatattctataaattccccggcgatttctttataatattcacaaagaatgtaacctttcttcacatttaattaaacgtttgttgaagaaaaaaatgagaaatcggtcatttctgcaaaaggaatcgggccgttcactgtcgaataacttttatcacttaacatttcatgaggtgaagggggtgacggccgcctgcatcgtttcggtatgaccatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttgcggaaatgctggacagcattcaggtggaagcgacgttcccggacggggttaagcttgtcaccgttcatcagccgatcaaagcggaggtgaagtcatgaagccgggagcgattcaagtcgcaaaggggaccatcaccattaacgaaggccggaagacgctggaggtgtcagtcaccaataacggaacacggtcagtgcaggtcggatcgcattttcattttgccgaagccaacggcgccctttccttcaatcgggacaaagccatcggcatgcgccttgatatcccgtcaggcacatctgtccgttttgaaccgggagaagagaaaaccgtcacgctcgtggaaatcggagggcgaaaaacggtcagaggcctcaacggcatggccgatacgtatatggatgagcggggaaaagagaagacgctgtcaaatcttaaaaaagccggatggatggaggaggcgatccgatgaaaatgtcacgtgagcaatacgcagaactgttcggaccgacaacgggagacaaagtcagactcggagatacggatttatggattgaagtcgaaaaagatttcacgaattacggggaagaaatgattttcggcggagggaaaacaatccgggacggcatggggcagaacgggcgtatcaccgggaaagacggagcgcttgatctggtcattacaaacgccgtcatcctggattataccggaatcgtcaaggcggatatcggggtgaaggacggccggattgtcggcgtcgggaaaagcggcaaccctgatatgatggatggggtggacccgcacatgattatcggtgccggaacagaagtcatttccggcgaagggaaaatcgtaacggccggcggggtggatacgcatatccactttatctgcccgcagcagatggaagtcgcgctttcttcaggcgtgactacgcttctcggcggcggaacaggtcctgcgacgggaagtaaagcgacgacttgtacatccggtgtatggtacatgtcgagaatgctggaagcggccgaggagtttccgatcaatgtcggtttcttaggaaaaggaaatgcatccgataaagcgccgctgatcgagcaggtggaagcaggcgcaatcggcctgaagctgcatgaagattggggatcaacgccaagcgccattaaagcttgcatggaagcagcggatgaggcggacattcaggtggcgatccacacagacacgataaatgaagcgggctttttagaaaatacgcttgatgcgatcggcgaccgggttatccatacatatcacatagagggagccggcggaggccatgcaccggatattatgaaactcgcatcttacgccaatatcctgccgtcctctacgacgccgacgattccatataccgtcaacacgatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggtggccgataaaatgaaaaaacagcgcggcgctctatcgggagaaaacagcaatgacaatgtgcgcgccaaacgctatatcgccaaatacacgatcaacccggctgtcactcacggtctgagccatgaagtcggttccgttgaaaaaggaaagctcgccgacctcgtactatgggacccggttttcttcggcgtcaaacctgaacttgtgctcaaaggcggcatgattgcccgcgcccagatgggagatccgaatgcttccattccgacgcctgagcccgtgtttatgcggcagatgtacgcatcatacggtaaagcaaaccgcaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacatgtcgatccgaaaacctatcaggtgttcgccgacggagaagagctggcatgccagcccgtcagctatgttccgctaggacagcgttatttcttattttaatccctctccggccggtttcccgccggcctgtttaccctctattgccaacttgatttcatcctgccgcccgttttagtgtatattagtagttgacaaacaaatgaaatgtaactattttggttacaatggtggtgaaaaacatgattaacagccgtcttgctgtggccattcacattttatcgctgatctcaacggatgaacgggcgtcatcggacatgattgcgggcagcgtaaacaccaatcccgtcgtagtgcggagaacgatcagccagctgaaaaaagcgggtattctgacatcccgggcgggtgttccgggagccagcctgaaaaaagatccgtcggagatcaccctcttagaggtttacagggcggtgcagaataaggaagagctttttgcggttcacgacaatccgaatcccgactgtccggtcggcaaaaatattcagcgcgcgctcgatgagacgttcggaagcgtacagcgggcaatggagaatgaacttgcgagcaagtccctttatgatgtaatgaatcatctcttttgttaaaaagagatgggttcatgccgctagacgtgtaacggaaatggttacaatgggtaatgaggaaatcacggttttggctccatattcagacaagcctggatgcgggattgcgatctgtttaatgaagaaaacctccgaaactaaaggaggtggtaaccgggatatttttattttgcttaaggcttatgtgaaggtgtctgttgtaagcgggttaccaaaaaaagacggaactcttattttaatacgcgctaaaaaaactgatggagaatatcctgcctccggtaatgccaaaaccgttcgcctcttcacaatcattataaaatttctcaaggaacgatcagcagcccgttagctgcccctcattagagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttccggtcggtctcttcgactggcggacactccagtactgcgtaaaagtagtgttatcgccatcaatggaaggtgcgttataacgtgtcgttgtatatatgtcatatgtacctccatcactctttacggtacctttatacgttccggtaggtctgtaagtaccccatgaatccaccacataatattcgatgaggggcgatctcgtccagccatataaagtcaaatatccattgccgttcggcgcccaaacaccggcattatagtttattgttctaaatggcgagcctgtagtccagcctttaccaacaacgaaattcccggtattagaccaattaacactgtaatttccgccagagccattgactgcgtttactgttccgcccccgtcagtccaattttgccagtaatctgtgccagctgcagaggcggttgccgaaaacatgctgatactcatgaaagctgccgttaatcccactaagaatttctttttaaacttaaacatatgttacctcctatactattttttctgactttgacatgaggcagcactcgtaaatatttaacgaacgccaacgcttttgatcgttcctttcaatataatagcatgaatacatgggtgaatattaagaacaattgtaatttaattacaaagacccaaaaaattgtatgatgagtggtcttgtaccgccatagccttatttcgcagaactcagtgatttcagttaaaactctgaggaaacgttttatttgaaaaaacttttttgccgaaagaatatctgcatacagcgtcaatgctgttcgccgtattggcaaatccgaagcagaaaaactttaccgttgtcggagaagcggaataagaaaaaatcccgggcggatgcgccgggattttcctttttaatatgtattggcatcaatattattaaacgcgtcgtccacgatgccgagcgtcatgaggacaatgaaaagaacgataccgagaacggacaagccgaccgtcacgatcagatagatcccctgcattttcacgaactttgcataattctccagcatatgttcctctgtcagttcattgaactgcgccgccatctgtcccgcttcatttgccgagcgcatcagaaaaatgccggcaatgatctgcagaacgccgggaatggctccgattaaaaagaaaaacgcgcccgaaagcgccgcaaacgcgcctataataataaacaaaatacctgtcgcttttccccatttcgaaatagaaataagcgaacgattcactgattcaggtttcaaaccatggcactcctttacaaaaaaatactcacttttcatttatacactattcggtcattcttttgaatataaaatgtgttttttcaagctgtgtccgtttttatatcagaaaattcccgagaaacatcccgggaattacaaaatcggcgacagaagccttgaaatcgattctttaatgcggatccgcagcgaacgctcctgatattcttcatacgtatattttctggagacgagcagatcttctttaaatgaggaaatgagttttttcgcgatggtgacgtcataaataaaggcgttgacttcaaaattaagtctgaagcttctgacgtcgatattcgccgtaccgactgaagccgtctcatcatcgacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcaatgcctgacagacaggcgatcctgagggcatccaaaagacttgagtcaggaataaagtaaggcgtctgaatcaggatcgaccgtttggccgttgagatcatcttgatatagccgtttttaatttgttcccattctgaatccggtccgctcgtgacaatctgcatcccgacattgcccttcggctcgcattccggaaaatgattcggaacgtaagtgagcgtatggtgatgggaagcttggttccaatcgagaataaaccgtgtctgaatggcgtgtaccgccgtgccttgaagtctgaggtgcgtatcgcgccagtagccgaatttcggattcaggccgagatattcatctccgacgttaaagccgccgacatagccggtttcgccgtcaatgatgacgagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacctttacgccttcccgtgcttttttcactaaggcatcgcgcaatttttttcccagttcatcacctttataaatatagtattgaaggtgaatgtgatcttttgcgttggaaatgtccttcattaagcgtttgaacttatcgcgcccgtccgttaaaatctccaccgaattatcctctgtaaagactgcgtggttgttcatgacaagcatatagatgaggtctttattatccacagtcgccctgttgttaaattggaattgcctcgacttcagatctttcagctgaaacttcagcagcttttctattccgatttttttacggtcttcccattgaaacaggtgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgggtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttgattcaggccccttccgggagaggagctctcgtatcggccggcatttttgccctccttgcggctctgggtcttgcgttttttaaggaagccggctatcagcggaaacaggtgcaaaaaacgatccggctttatatgctgaacagaatcagaaaaagcgatattctgtccgaggaacggaaaagcgcctacacccggctgattgccgaggagccgtctgcgatgaagagctttattgaatttttaacggaagaagaccggaaaaaagaaatgctgtattaaaaaagagctgacgcgcgatcagctctttttgtcattcaaacacaggatcgttctcatagtaatatgaatcaggcgtgtcatacgtatcagtgctgtaataagccataattccgatgacagcgaagatgacgactaaaataaaagcgagaatgcccagtaccacactggatgccgcgtaaaaaaactgcattttgataaatgacgcataatgtgcaagcatattttcttccgcgttttcttctagcccttcctgaagggcggcagccgcttttgccgagcgcatcagcatgacgccggaaatgatgagcagaacacccggaatggctccgagcagcgtcacaatggctgacagagcggaaagagaacctgtgatgatcagaaacacggcggtgatctttccccatttggcgatgtcggcaagggaacgggcttttttattgagcggctggttttcgtctttgtctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcagaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcaaaaaccaatccatctggtctgcgggcgtcacttcttccgtatcagccgttaccattcgtgaggcaatcgtcgagttgtatatggccaccaccgcatctaaatcctccaatacggctttgcgcagggttaaattcatattccgggatctcccttcacatttcattacataattaagtgcaatctgcacatactacttctaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggcggaaactccgcgtatgacagcggcaaagacgatgccgtcgaagtaggcaagtcaatggaaaacgtcgcaatgccggctgctcattctgaaaatgtttctgttgtgaaaaagttttacgaatctgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagacccggtactggggtatgtggttgaaattgaacactcagacggcctgtctactgtctatcagtctttatctgaagtcagcgtggaccagggcgacaaagtaaagcagaaccaggtcatcggtaaatccggaaaaaatctttacagtgaagaaagcggaaatcacgtgcactttgaaatccgcaaggacggcgtagcgatgaacccgctcaattttatggacaagccggtaacatctattgaaaaagcggcggctgaagagaaaaacgctgtgacagaagaaacggaagggtcaattcagcagtcttccgagaaaaaagatgtgacgcctaaaaaagaaaccgaagaaaaaccaggtgacaaagaagacggcacaaaagacaagacagatggtaaagatgacggctcaatgaaagattcgggcaagtaatcttgatcccaaagcgtctatcagctctgataggcgcttttcatattgctgcatgtgcctttatactaatagaaaacgaaggagatgctgaatgaataaatgtctggcggccgggtggctcgtctttgttttcgtttctgctttgactgaaagctttcacgatatgattgtgtcgcagacggtgtccttccgtttcacgtcccatccggatgtgtccggtttctttgtgttcgatatggcggagctcgccataccggaagcggcgattcaaaagctcgggcacgcgttttcattttttgtgctcgcctatttgtttttcagggagcgcaggcgcatgaagagggcggtgctgtatgcattggccgccgctttcctgacagaaatcgtccagctctttttcggcagaaacggatgcctccgcgatgtgctgattgacagtctcggcattgccgcattctgggctttacaaaggaaaaagcatacagccaaacatacaaaaaccggcagtctgtgacagacgccggctttttttatatattatggtttgtcgatttgcttttatgaacgatactttcatagattcgcacgatcagatcgacaatcggacgaagcacatttgaaaatctgaacagcaggaatccgacaatgagggaaacgataatgcttccgagcacatcgatcggataatgatggccgacccaaattcttgagaagccggtcaaaaggccgaaaatcacaagcggccagccgagttttttgttgcggaacagaatcgcaattgaaatcgccaaagcgcctgtcgtatggtcactcgggaatgaagcatccgcggcatgagggatcagcgtatgaaccgtatgctcgacaaaggggcgcggctcgacatagactttcgtgatgaggtagttgatgataagcgccgcaacacccgtgaagcccgcgtacagggcgttttgtctgccttttgtgcttccgaacagccacatggcaagcaggaaaagggcgtaggcgtaaatggcgtattccgttataaaaaccatgatagagtcgagaatggcactatggtgcgacaaaccattgatcgctttaaatagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaacgccgatctgccgcttgtgtttgtcattatgctgctttgcggattcggcttgttaatggtgtacagcgccagtgatgtgatggggtctcagcggtacggagatccatcctatttcttccataaacaaagtgcctctttactgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccgcttgtcgtacagccgtctgaattggcgaagatcgccatgattttgtatttcgcttcggtttatacgaaaaagcagccgtacattcatcaatttgtgaaaggggttctgccgcctttagtaattttggggaccgcttttctgctcactttggcggagcctgatttagggacggcttccttaatcctggcggcgtgcgggtcgattttattatgtgccggcttgaaaaagcgccatcttttcgtgctcggcgcgacggcggtgtcgggggttgtttatctcgcattttctgcatcctatcgtgtgaagcgcctcgtttcctttaccaatccgtttggtgacgcgaacggggacggctatcagctgattcaatcctattttgctatttccggaggcgggtttttcggaagagggcttggaaacagtgttgaaaaaatgaactatctgcctgaggcgcataccgatttcattatggccgtgatcagtgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtcttgaatttgggagcgatgagcggactcctcccggttacgggtgtgccgcttccgtttatcagctatggcggttcttcattgattatgacgctgtttttgtgcggcatactggtcaatatcagtacatatgcgaaaaaacaaaccgtacggcataagcgtcctgccccgcatgaaaaaaaggcttcttctttttaatgaagcccgaaaaaaacgcccgggacatgctgtctccgggcgttctgtctgtttataaagctcctggtccttcttctccggtgcggatattaatcgtgtttccgatttcatagacgaatattttgccgtcgccgggctctcccgttttcagcacttttttcgccgtttccaccacttgatcaacggggaccttgctgacaacgatttccactttcagccgttcatatacattgctttcaattttgactccgcggtacagttcggtgtgagctttttgaaggccgcagccgtgtacgttggagaaggtcagcgatgtgactccgattttaccgagttcctgtttcaatgtttcaaacttagccggacgcgtaacgatttctaccttgaacatttgaccgctcatctaagccactcctcactttataagtcctgatatgctttttccccgtgcatcgttaaatcaagcccaagtgactcttcttcttcgctggcgcggaggggaatgaacagacctacaattttaatgataacgaaagtgacaataaatacaaatacataggttgccgcaatggccgcaatctgcttccagagcagtcccggatcgccgtaaaacagtccgtttgccccgccgtcattgacggaagtggtggcgaataaaccggtcgcgatgccgccccatgtcccgccgattccatgcaggccgaaagcgtcaagcgcatcatcgtatccgaaagtctttttgagccaatacacgccccagaagcagacaagcccgccgatgaaaccgattacgatggaagagaacggcgtaacgaacccggcagccggcgtaatggcgacaagcccggcaatagcgcctgatacagcacccagcatggtcggttttttgttcagcatccattcgattaaaatccagccgataattccggccgcagccgcggtgtttgtgttaatgagggcaaacatcgcgatactgtcaagcgtgagggcgctgccgacattgaagccgaaccatccgaaccaaatgagcgccccgcccaagaacgtgtaaattaagttgtgaggcgaagccgccgtgccgtccttgcgtttcccgagcacaatcgccagcacgagcccggcgaccccggaagaaatgtggacgacgtttccgcctgcgaagtcaagagcgcccatttggccgatccagccgccgccccatacccagtgcgcaacgggcgtatatacgagggaagcccacaaaaaggaaaatacaagaaaagcactgaatctcatgcgttcagcaaatgctccggaaataatggccgtcgtcagtacggcaaacgtcatttggaacatcatgaataatgaatgcgggatcgtatcactataacttccgggttcaaagccgacccccttcagtccggcccattcaatcccgccaagccatgtattcccgggggcaaaagcaagtgaatatccgtacaaaacccaaacgacggatacgatggcgagggaagaaaaactgtgcatcgccgtgctgagcacgtttttgctttttaccattccgccgtaaaacaaagccagcccggggtcatcagccacacgagtaaagcgcaaaagaacataaatactgtatcgcccatctgcatgttgtattcctccgtctcattcaaaatgtaatcgtgattaattcattattatagagaaaaaagaacgataaaacattttcgtgtaaggttatctgacatgtttttttgcgttcataatgtcgctttttcaaaggggtgtcatgcgactttatatccataaaaagagcgctggagcatggcggaagaaatcctgtccgggaaagagtaaaataaacggggtgagaaacactaactgcatcaggaggaattattatgacaacatcattgaatctgcaatttgaaaaaacggctttggtccttattgatttacaaaaaggcattgtgccgatggataaaagcggtaccgttgtgccgaacgcgaaaaaattaattgatgtgttccgggaaaaaggcggatttatcagctttgtgaacgtagattttcatgacggagcggatgcgctgaagccgctgacggatgaagaggcggcgggccattcggctccgccggcggattgggctgaatttgtgcctgaaatcggagtgaaagaaaacgattatacggtaacaaaacggcagtggggcgcgtttttcggcacggacctggaccttcagctcagaagacggggaatcgacacgattgtgttatgcgggattgcgacaaacatcggtgtggaaagcacggcgcgggaagcttttcagctcgggtatcagcaagttttcgtaactgacgcgatggcgacattcagcgatgaacagcacgaagcgacactcaaatttatcttcccgaaaatcggcagaagccggacgacggaagaatttatcgcacagacaaaatgacaatctccaaaaaaagccgcgtcctgttcttgacggccgtggcttcggggacgatgctgaacccattgaactcgtcgatgatttctcttgcgcttcacagtattcagcatgaatttcacctgtcgtttacaacggtgtcctggctgatatcgtccttttatcttgccagcgcggtggcgcagcctgttaccgggaagctcggtgatatgctcggcaggaagaagctgtttttgatcgggcttctgcttgttgccgtctcggcggtcggcgcgccgtttgcgccgacttttatgacattgctgatcatgcggctttttcaatcgatcggaagcagcgcgatatatccgtccggcgtcggattgatccgttcaaatatacaggagaagcaggcttcggcgctggccgtcctgtcaatctttgcatcagccatgacggcgctcggtccgactctcggcggttttctgatcgtttggggagggtggccggcgatctttttcgtcaatctgccgtttatcatcctcagtttttttctcggaatgtatatgtttccgaaagatgaaaaacgcgagatcggcggcttgaaaggcgtgctccgccagcttgatacaatcgggatactcctgtttgccggagcgattatccttctcctgtcgtttttattgtccttcagtacgaagcctcactatacagaaggcgtattcgggcttttatttgtcgggctgtttatctggcgtgagctgaaaacagagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcggattgattatgctgtttatgtcgggcatgagtattctggtgtcgcctttgaccggaaaatggatagataagaaagggcttcttcagccgattgttgccggaacctgcctgaccgcgatcggagcggtgctgttaacgtttttcttccttcaggcgcccatgataggaaaagggctgatcctgtccgtgctgggtgtcggctacggtttcggaaatgtcacgtttcaggcggccatgctgaaaacgagccccgccgacatggtcggaacaacgtccggcctgtttcagacctgcaggtatctcggttcgattttgtcttctgtcattttgggcattcttttcggaaaagaaattaccgccggccattttcatatgctcggcacgattcttatcgttgtcggcgccgtaagccttttgatggcgttccggttttcggttctcctcaaaaaagcctcttaacaggcgcaaaaaaaagagacgggctctccccgtctctttttttgtgtaatgtgctcaaaaatcaaaacgattattgtcgacagcgaccaatgttatttgcggaattttcagttatattttttcacatgtgatgtaaggaaaacgtacatgcaggagggagaaaatgacaaaaataacgagtgatcggctaagcaacaaagatttactgcctttagaagacggcgaacggacatggaaggcggtgaattttgcatccatctggatgggttgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccttttccggtcattatcagggcttcttacggaatatacggagctaacattccggcgcttctcagggcatttacagccatcatgtggctcggaattcaaacatttgccgggagcactgccttacacattctgcttttgaacatatggccgggctgggggagtctcggcggagattggaatatattcgggcttcatctgccgggctttctgtcgttcattttcttttggggcattcatctgcttgtgctgcggcacggcatggaatcgatcaaaaaatttgaagtgtgggcgggcccgcttgtttatctcgtcttcggcggcatggtctggtgggcgatagatattgccggcgggctcggtccgatttactcacagccgggaaagttccatacattttctgaaacgttttggccgtttgccgccggagtgacgggcattatcggaatatgggcgacgctgattctgaatatccctgacttcacccggttcgccgcgtcgcaaaaagaacagattcgcggccagttttacgggctgccgggaacgtttgcgctgtttgcgtttgcaagcatcacggtgacatccggatcacaggtagcattcggagaaccgatctgggatgtggtggagattttggcccggtttgataatcctttcgttatcgctctttcggtcatcacactttgcatcgccgccgtctcggttaacgtggcggcaaacatcgtgtcaccggcctatgacttggcgaatgtcctgccgaagtatattacattcagaaggggagggtatttgaccgccgttttggctctgttcacaataccgtggaagctgatggagagcgccacgaatgtatatgcgtttctcggactcatcggcgggatgctcggaccggtggccggggtgatgatggctgattattttatcatcagaaaaaggcagctctcagttgaagacctttattcagaaaccggacagtacacttattacaaaggctataattaccgggcctttgccgcgacgtttctcggcgcgtttatttctttaatcgggatgtacgtcccggcgttcgccggcatctatgatatctcctggtttgcgggtgtcattttgtcatgtctcggttatacggcgcttatgtacattcatcctccttatgcaaaagcggagggacgaatcgtgcgggaaagagcggccgaataaaaaaagccgggggctgcccccggctttttgtcatatcagtctgcgattgaaacgtttccgtccgcttcaagcggcgttctttttttctggctccagccatacaggagcaaagcaatcaggacgaacagccccgctgccagataaatcgaatggaatccggccgaagcgacgaagaggccgaatacatatgacccgccggcaatcccgctgtcaaagaaagtgaagaaggtcgccgtcgcaaagcctgaacggtgtccgggcgaattctgaatcgccagcgtctgcatacacggtacgatagagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcacggcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaacacagtcgttccgctgttgttttgatccggcacacgaatcataaaagcaatcagcaagcctaaagaaacaaatacagcaaaaagcgtaaagaacaccgggaacgatatgactttcacaaggctcagtccgagaaacggaccgatcgccatggcaaggttcatagacatcgcaaaataaccgagcccctcgccgcgccgcttggcgggaataaggtcagcggcaattgcgcctgtgaccgtcgttaaaatgctgaaccagatgccttggaaaaaacgcagtccgagcagcagatagaaattgtgtatcggcaaatacagataagaagacagggcgaacagcgccagagatacaatcgtcattcttttcttaccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaatttacgagtacgaccataataaaatctttggtccagatcgagtcagatttactcaaaagtacagcacttccctttctttattatttcgttaaaaacacattcagaaactcagaaaaagcttccttatctccatcttggaaatccgcaagcatgtcttcctcgaacttcagcatctcttgattgatgctgttgtatttcaattcagcttccttcgtcaggacgacgagcttttcccgcttgtcttctccctgttcccgctgaatccagccgttttcttcaaggcgtttgatcgttctggtaacggtcggcgcctctacgttcagataagaccagatttctttttgggtcatcggtccgatcgtttttaagcaatataggattgaccattgagaggagtacaggccgaatggttccagccgttcattggctttcttcgtaatcaggcgggcgcattgattgatttgatgaatgaggcgtctgttgacgtggatcatttccgttctccttttcaaaaaacttacctaagtaactaattgtgctgtttcattctacagcaggatcgcgcggatgtaaaccccccgttcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatctgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacagaacgcctgcctgaaatcaatcctgacttggcgaatgaagtaaaagaaatactcgattatcataaatccatcagacatttaaggggggcgaggcgacgaaattaaagtacaagaaggatgaaattcttgaaggggagcccgttcagcagccgtagcgcctgacgtctgccgggcccttttttctcctccgggcggtttcgcgaatatccgcaaaattttgtcaagaacttatatcgatcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaactgaagctatgctgaaacatttcattaataagctgaatgtaaaaggacttttctcaaaaccgcgtatgctgatctgctgcccgacgaatattacatccgttgagcagaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggcctgccgagaacgattacagtaaacagcaaagaagtggaagaagcccttcgtgaatcagttgccgtcattgtgcaggccgccaagcaggttcttgaaagaacaccgcctgaattgtccgctgacatcatcgaccgcggcgttatcattaccggcgggggagcgctgttaaacgggcttgaccagcttcttgccgaagagctgagggtgcctgttcttgtcgctgagaacccgatggattgtgttgcggtcggaaccggcgtcatgctggataacatggacaagcttccgaaacgcaaactgagctgatgataaaacctcattctgaaaaagaatggggtttttttctgtcaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacgtcaggatacaaagaggatcaaggttcaatccgcgcctttcccgagatgcttctgagccgaatagaaggcgataaaaaaacgaaaatcggttccgtcaacacaggcgtatacatgcaggagctgaaaccgttgtttacgcagggaagcctgaaaacgaccgatcagccgacggatatcgcgcttatggagaatcaggttcccaagaatgccgaaacgaatgaaaacgccgagctgttttatcccgtgcagactgcgggcggcgtccgctattcaaaaagcagcactttctcattaaatgaaaacaatcagcttaccataaacggaaaccttgttttatcaacaaacggacagccgattacagtcgacaatgaaaaattcaccgtatcagaaaacggaacggtcacgacaaacggccggccggcggggcagattgacatcaggatggaagaagacgtgcgcaatctgaaacgggacggcaatgacctatacagcacggccgacggcactgaactgccgagcgcggcggcgaatccccaggtctcgtattcattaaagcaaggcgtctcggagctttcgaatgtggacgtgacgagcacgtatacagaaatgacggaagcatacagatcatttgaagccaatcagaaagtcattcaggcttacgataaaagcatggataaagccgcaaatgaaatcggcaaagtgtaacaaaatgggggacgttcaattatgatgctcagatcaatgctgacggcttcaacagccttaaatcagcttcagcagcagatggatacagtcagcagcaacctttcaaacagtgatacgacaggctataaagcgagggactcccgcttttccgagctgatcagacagcagtatgaccatatagatgacaaaaaggaaaattcgccgaacatgcggaaaacgccgcccggcctgcgtctcggcgccggaacggtcatgactccgcagctggactcagggcagggaggcatcaaaaaaaccgaccgtgaccttgatatcgcgttcacctcaccttatcaatatcttcaggcagaagcggacggacggcgggtgtatacaagggacggctcactttccctcaagccggccggcggaaatgaccgggtgcttcagctgttgacagcgggaggcaatcccattctcgatgagaacggccagcccatacaaattgacagttcgctgaatcagctgaaaatcagcaaaaccggaacgctgactgcttcagacccggcaggaacccgttcgcagacgtttaatctcggcatcgtcaatgtcaataatcctcaggcccttcatgcggaaggggataatctgttttccgtaaacggagcgggggcatcagcgattgaagagcttaccggcgcaaaccggcaggcaatcggcatggagcagggcgcgcttgaaagttcaaatgtcgatatgtcaaaagaaatgaccgacctaatcgtgtctcagcgttcctatcagctgaacagccgcacgattacattgggagaccaaatgctgggcttaatcaactcagtcagataaaagaaggggcgttttgatcagccgcgcatgataaaaaatgcggctttctcaaaatcgcccttttttttgtagtaatcagtaatatcctgaagcagcacttccaaatccacccacgcttcaattttctgcagctccagcacgagtttctgcaatcggtcgtacgggtcctcctgagcggtgtacagtatgttgagcgcggtcagcttcaatttcattatcttgttctgcactttttcagatatgtataaacctttctgcagcacggtttgtccttcggcggcatatccggttttaaaaagtgctctgaccgcttcgtatacacaatgcaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattaaagagctgttctgcgtcttcatagcgtgcctcgtctatgtaattcacggcgagaagcagacggcagctgagcgtttttttgatgtaaccgaattcaccttgatagatttccagcgctttattgacatattgaatggagagcgcaggcgacttcatcatgtaatatgcacccgctgttttataataaaattcagcggcttcgaaacggtcctgaatggccggcaggtactgttcagcttctttaaagcggcagacagcacggttcggagcgccattcaccatatggaataaccctttgaaaaaatagaaataataagttaattcatggtccatctcatctttgcgccgcttcagctcgcagaacaatttagtcagaccgtcttttttctcaaacagcagctgaaaccgtgcgaaaaacagctgatatctgagtttgagctttgcattcttttgtaatttggggagatgctgattgatttgttcgtgaagggaacgggctagatcgaattggcgttttcccatggcgtcataccactcattcagcatcaccagcgtacgtttttcagtaaacttagcaatcatcttccaacctctttgcatagggtaaaaatctttatttatcataacacattaatggacgaggctcattgccagctggttacagtttacagcgcggttgaaaaagaaattgattcataatatacttccaaatgtacagattggttagcgcatataccttctatacatactattgtcgatgaaggagatgtcaagaaaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtcttaatcgtagaggctttggcgcaggtcggagcggttgcgatgctgattaaagaagaaaaccggggcagactcgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacatttgcgctcggagaataaaaacaaacgaatgggcttataaaaaagcccattttgtatagaaaggggtgaatgtaatgtggtcagaatttaaaagctttgcgatgcggggcaatatcatggatctggcaatcggtgtcgtcatcggcggcgctttcggcaaaattgtgacgtcgctcgttgaagacatcatcatgccgcttgtcggcctgcttcttggcggtcttgacttttcagggctggccgtgacattcggcgatgctcatatcaagtacggaagcttcattcaaacgattgtgaacttcttcattatttcattttctatctttatcgtgatccgtacaataggcaagctgagacgtaaaaaagaagcagaagaagaggctgaagaagcagaagaaacagatcagcagacagaactgctgactgaaatcagagatctgctgaaacagcgggctcctcacaatgactaaggcacaaaaaaaggctggatgattaacgtccggccttttttatgattataatttttgtttaaacgcttcaatcagccggctgcccgagtagccttctttcacgagcgactccagaatgctttctgatccggggtggtttcttgacaccatttgaccgtaaattaaaacttgtatactcttttccagctccacaatatttttgatgcttcccgtcagctgggcggggcggttgctttttttcgtaatcgttacaaacaccttcgcttctttctggcttttcatcagcatgtcaaaaaaagaaaagtgttcggccgggaccagtgcttcaattaaccagtggttttctccgtcctctttgttgataatcaatccgtctaaaaggggaaactgttcaatcggctgatcgtctttatctaaacgttccacattcagatcaaccagtttaaaggttttcatctcttattttcacccctgttgtccatgtttttcgttcatttattataacacatatcatttttcccgggaaaatgctgtaagacatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcattgactgataaaaagctgagtttttactggttcgcatgggacggcggaaagtttgtccgcatgtttgagaaagactggctcaaaacgaaacttttctcgcggctgctcaaaaatacatattacataagcggtcaaaaacaaaagttttttttatcagaaagaaaaacaaaaacataaaagcagcccaaacggataaaggctttttccgctttttgctttcataagcctttatactacaatgaagccagcctcgaaaaagagaggaggagacggcttgtttaaccacgttatgcttgtcggccggctgacgaaagacccggagctccgttttacatcagcgggcattcccgtcgctcatattacgttggcggtaaaccgcaattttaaaagcgcgtcgggtgaaaccggaaccgactttgtcaactgcaccatctggaggaaaaacgctgaaaacacggcattgtactgccaaaaagggtcaatggtcggtgtaagcggcagaatccagacgagaagctatgaaaagacagacggcgtaaaagtttatgtgaccgaggtcatggctgataccgttcggtttatggatcaaaaacggaaagagccgctggctgaatagcatgcttttttcctcgatttcccgcctttcagcgggccccgcaatacctccttcccattcgccagtcgaaagactggtttttttgtgcgggagctgaaaaatggttaaaaagaagtgatttcgcttataaatacttaaaaacattgaatatattgggataaaaacttataattacttacagataagtgacgaaaaaaagggaatgaggacgtgtatcaagaagaaagactgattgcgataatggaatatttgaaacagcaccggcggatcaccgctgaacagatatgttcgctgcttcatatttcaagagataccgcaagaagggaccttgtaaagctgaaagagcgaggggccattatcagaacacggggcggcgcgattctgccgtcagtgaatcaggaagttccgggctattcgggccggctgaaaaccgtttctgaagagaaaaacaaaatcggcaagctggccgcatccctgattcataaaggagaccggatcatcctggacacatcgacaaccgttcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgttgtagaaaaactgggggattatcacgctgataaggtgctgatcggcgttgtcggcatctcggaaaacggcctgacgattccgcatgaagaagacggcatggtaaagcgtaaaatgatccgtcaggctgaacaggtgattgcgctgagcgatcactcgaagcttggccgtacgagtttttatcagtatgcagacctgcacgaggttgacctgctgattaccgatcggctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagtgatgaaaacaagcgggctttaagggaagcccggcaagcgggaattgaaatcgtggtttccactggacgcgcgcattttgatgtgcactccatatttgaaccgctcggcataaaaacatggattatcagcgcaaacggagccgccatccacgctcctgacggcagcctgtaccattgtgaagcgattgaagaaacaagagcccgggggattttgtcatggcttgaagagaatcaatattattatgaggtgtttacaaacaaagccatctatacgcctgaaaccggcaggcagctgctcgatatcgaaatggaccgggtgaaaagcgccaatccggaaaccgatctttccgttttggaacaggcggcttcagtgcaatacagccagtccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaactttgaagtggcgtctcgaaacgcctcaaaagggcaggcgctcaaacggctggcgcaaaagctcggcattccgatggctgaaaccgccgcggtcggtgacagcttaaatgactattcaatgcttcaggcggccggaaaaggcatagcgatggggaatgcgagagaagatattaaagagatcgctgatgccgttacattgacaaatgatcaaaacggcgttgcgtatatgatcaggaatttactgtgaaaggtatggcgatactgttcatgactggcgtgacgcattcatggcaaatgcggcgtaacagtaaggacgacataaaagaccggctcttccgagagagccggtctttttgcgtttaatgtgattgcgtcgatgcgctgagggtgaataattcttcaagctcatcggatgacagctcggtaatccaattttcactttggataatctgatcgttcaaagtttgtttcgtttcgagcatggcatcaattttttcttcaatcgttcccgtcgtaatgagtttgtgaacgtggacgaaccgttcctggccgattcggtaggcgcggtcggtcgcctggttttccaccgccggattccaccacctgtcatagtgaatgacatgattggcagccgtcagattcaggccggttccgcccgctttcagtgacaaaatcagcgtcgggtattctttcttctggaaccgttcgacgagggaatcgcgttcctgcttggacaggcttccgtttaaaaactgaaccggttctccgaatgttttttccaggaggcgcttcatcatgttgcccatctgaatgtattgtgtgaaaatgaggcagctttccccttgtccgcggatcgccgccattaagtcaagcagcttttccagtttgacggatctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttttcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgattgcgcgggactgcttcgtatgcgcgtttttaatgttttgcgcttcatcaaggcagacggtgctccatgtcacggaagaaagctcttcctgatcggcgtgcgagaggccgtaagaagtaagaacgacatccgcgtcctgataggccgggacaaatgcttcccccttcggcctgcgggggccgtaatgaagcacggccttcagctgcggcgcgaaggtctggagctcacgctgccagttgccgagcaccgatgtcggcgcaatgattaaggcaggcgctttttgccggccgctttccttcacatggagaaaataagcgatcatctgaatcgtctttccaagtcccatgtcatctgcgagacaggcgccgaagccgttttcccgtaaaaacagaagccagttcatgccgtacatctgataagggcggagctggccctgaaacgcggcgctgacttcatgctccggcagatccccggcatccgtcagtttgcggatcaggcttctgagatgctttgataattcgatcttgatcccggcaaatgccgatgagtcaatgatgtccgtgtcctcggctccgttttccccgtgatccatcagttcgcgcgccagcacgtcggacatgtggaggccctcagattccgctttttccatcagtattttcatctgtttaataaattgcggatcaattttcacccattggccgcggatgttgacgagacgtctgttgtttgcgacaagctcattgaattcatcctctgtcagctcaatcccgttcgtggcgaatctccagttgaaatcaagcagagcgttcatgccgacgaaggactcgccccgcggggaggatgacactttcgccttaagcatcatattgctgtcccggacaatctgccaccatgatgggagaagaatctccacacccatatcgacaagcgtctcactcgcttccgataagaagatccaagcctcttcttcagatatcagcgtcgttcctgaatcaaacgaaagccagggaaccgttctgcggaagcggtcctgttcacgcgcgatttttccgctgtatgcctgccacgcttttttcagccctttcagtccgtcgaaaaaggtgatggagccggtttttttctcacgtaaaaacatctcgattttccagtcgtcaccgtcgaaatcaggctcgtttaatcggaggccgacggtaaacggcgtcagatcgtcatgccagccgattccctccagaaaatcctcttcatccaaaaaggagcctttaaacgtatgaacggccggcgaacgggtttcgatccgccgccatttttccagcaggtcatcattgtactgaatgtagtcctgtaccgcggctgagaaccagtctgccgtaaagccttccagcaaaagctcgcggtctttgaagcgcaggaggccattttgccatgcgtcataatccggaagaaaatcgccgtcggcaataaattcgtatatcgtcgaagccgcttcgattaacggttccgtttcctttgtcagctgcacggtgctgaatgaattgaacgagttttttccaagcagctcgacggtcatccaagggctgagcagaacggccggagtgccgatgaagctgacgtcttcaagaaacgttccgtaaaaggtggactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtagcttgcgctcagccggctgatataacgctcccatacctgctgtttttttgcctttttataaagcgtccgcagttttttcagatggcgcgcagcctctttataggcgctgcggtttttttggtcgataaaaaaggccgccgcccggtgataggaggggatgagcgcttccggatcactggcggcaatttccttcaggatgtccttttcaatttcccagacggaaaaaccgacgaggctgtgaatctccacccattccgcgtaccgccgtttttcgtacaggtactggctgtattcggtaaaggtatagggaaggcagccggaagcaaaccgttcaaacagctgatcatcccgtgagtgccgcgcataatccgccaacagcgcaaacagctctccgatgatgtcgcgcatttctttaaacggcttatcaagcttcgtatagttcacggcaagcggttcgatccggccataccatgttttcagccgtttccagtcttttttcgcggtgagttcaccgagccattgaaaagtgtacggcagcgcttcaggagggaagcgggacatatcttcaaagaccgcttcatcatctttttgcaaaaaggccagatgaagccgtccgaaccgcacttccggcgaaaaacggcgcccgctttcctgttcgagaatctcttgttcacgcgcgacccatttcggccggttcaaaagcgcgctccacatttcaccgaatacccggaggcgttcgtattgaaaaagctcttctttcacaagcagtctgcggagcaccgggggcgtccggtctaaaaaaggatcgagtgaaaaagacaaggcgtacgttttcagtctgtcaatggaggaataaatcgtatccatcagctgttccacgtatggattaatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctttcctcaagcttttctctttccagccaatgttcggtaaaggtaccgacccgctcgaattgggcatatacgtaaagaaaaacggcgagcacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacatcggtgagcagtcctctgagatgaccacaaaagaaatgcttgagaatttgatttcttatattaaaaatggatatgcaacataaaatcccgcagcctcctggccgcgggattttttaatcttcctgtgacaccagtatttaaagcgcttacaaatataatacagattgaagtgattgtctatttttgtcgaattttgtcatttgaaaaggttagaaatgacagtttaaagctgtataatcgtaattggaaaagatcattggagggaatgggaatacacggaaagtgatatggaggttatatgggagaatctgcaagcataaaggaaatattcgcaatactgagaaagcgtctgctgtttatacttattattaccgcggcggcatcttccgcaggcggtctcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagcccggtcatcctcgatgaggtgattaaacagctgcatctgtccatgacttcgaaagagctggaatcgaaaatcacggtatccagcgagcaggattcacaagtcgtgacgattgccgttcgggatacggatgctaagcgggcggccgttatggcaaatgcggttgcatccgtttttcaggacaagatcaccgccatcatgaacgtggataatgtcagcatcctttcaaaggccgaagtgtcggacagccagtcaccggcagagcctaaccgtaagctgaacatcgcgattgcgtttgccgccggacttttgggcggaatcggtctcgcctttttgctggaacatctggataatacgatcaaatcggaagaacagctggaagcgctgctcggcatcccgatcctgggaacggttacttcaatcagtactaaagacagcgttgccaaaagcttgaggatggcggaaaccaaacaagcgggaggcggacatgttgacgcgtaaaaaagacaaacccggaaaacgaagcgtgattgcgatgtctgagccgaaatccatcaactcagaacaatatcgcacgattcgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatctgcgcaaaccgacggttcatttcaccttcaaattggataacggaaccggattaacgtcgctgctgttaaaacagatgccgtttcagaatgccgtcctgccggctgatgaagcaaacttggatattttaacgagcgggccgagcccgcccaatccggcggagcttttatcgacgggtgcgatgaaagatcttctgtcagaagcagccgcagtttatgataaggtgattttggatacgcctcccgttttggccgtagccgatacgaaaatattaggcagctacactgacggggccattatggtgatctcaagcgggaaaacggacaaagaaaaagcggccaaggcgaaagaagcgctcgattactgcccgtgcaagctccttggggccgttatgaacgggaagaaacaaacgaaacattcggactacgcctattacggacaataatgtcacaatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggatcggcatacggtcaacgaagcggtcagcctgttaaacaaacgtttgaataaggaaggcattccgctgactgttctgccaggccaggagatcagaatagacggagatctgctggcaggtcttcaaagcggctcgcttgccccgctccataatacaaagtatgtgctggcggaatttccggcggatcatgtcccggcctatgctgaaaggctgttttatgaactgcagctgaacggatatgtccccgtcatcgcccatccggagcggaacagggaaattcgcgaaaatccttccgtcctttacagtcttgtgaagaaaggggcggccgcccaagtgacggccggctgcattgccggagcattcgggcggaaagcgaaatccttttcgctgcagctgatggaagcgaatttgatccactttctcgcatctgacgcccataatctcggaccgagaaatttttattatcaggaggcgatcagcgttctgaaaaaagaagcaggggcggagctgatttacatgctcacggaaaatgcggcgcttctcgctgaaaacaaagccgtttataaggaacctccgctgcctgtggcccgccgtaagcgctggggtcttttttaatcgtcgtctccatcccgtttaaatgaagcgtaagcggctgttttgcaagatgattcttttatgcttatgctattatcagcggccggcgccgttttttcctatcatgacctcaggctcccggcattccgccggtgccgggatcatatgataatagcggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgacgaacgtaaggttgagcagatgagaaagggattgtcccctatctttgaaccgggccttgaagatatgatgaaacgaaatatcggccggcatcggctggcatttgaaacgagctacgaaaaagggcttgcggaagcggacgttatttttatagcggtcggaacgccgcaaaaagaagacgggcacgcaaaccttacttatattgaaaatgtcgccgaacagattgccgaacatatttctaaagatgcgatcgtcgtgacaaaaagcacggttcccgtaggaacgaatgacagaatcagcgaagttattcattcacggctgagagcggacgtgaacatttcaatcgcttcgaatccggaatttctccgtgaaggttcggcgattcacgatacctttcacggcgaccgcatcgtgatcggggctgaagaccggcagacgcgggaaacgcttgaccgggttttcgcgccgcttgcgattccggtatatcatacggacatcagaagcgctgagatgatcaaatatgcgtcaaacgcatttttagcggcaaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctgggcggtgtgacggggaaaaccatcgcgttattagggctgtcttttaagccgaatacagatgatatgcgggatgccccgtccattgtcattgcggatcgtctggcggctcttgacgcccggatgacagcgtacgatccgatcgcgtcattccgggcttccgggctgcttccgtctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggcgggcgtggaatatatctcaatcggaagaagagccgtcgtgcctcagactgattctgtcacttgaaaggccggcggtccgcgccggccttttatcatacaatcattagagacgaaggagatattaatcgtggaaaacacatggaaattgccgaagcaaatggaatcatcccgcggtctgctggaaacgtcagcacggccctttatcaaactgcacgtcaaaaaagctgaaacgggactgtatgacaataaaattgccggagacccctattttccgaaacatgaaccataccctgaagatgaaagcggcaggccgatgaagcttctcgcccaaatcaattttgcggatatgcccggactacctgattttccggacaccggcattcttcagttttacatatcggtcagtgatgacgtatacggtttgaattttgacgacgggtgcgcgcaaacgggtttctgcgtcaaatattttgagcacgtgacagatcgggaagaggagctcatggatgatttttctttcgttcaggttgaagaggagtacgattttccgattcaatccgaagcgctgatcacccctgagctgtctgctgaatgggcgctcccgtctgattttcaattcaggcaatatgccgggatggatgccttcgactatttcgagcagtttgacgatgaggtgtatgacgaatatacggtgaacgcattcggccataaaatcggcggctatgcgtccttcacccaggaagatccgcggtcttattcccatcaaaaccatacgattctgctcttgcaaattgattcagatgatgacattgattcgatgtggggagatgtgggaatcgccaatttctttatcagaccggaagatttgaagaaaaaagatttctcaaacgttttgtacaactgggactgcagttaacgacattattagaatcatgatacaaggcaaaggagacggttattcactgtctcttttttttagggaatttatcatggatacatagaggagatcaatgaatggatatgccgtttgtgtgagtcttttggcgttaatgatgagcatctcggctgctgaaaataagtcatttaacctatttaagctgctttctgtctattttaaaatataatatatggaaatatagtatggaaaagtctgtgctttttgtacgactttttgcgtaagacgaggtgaaaacagatgagccattcaagcacattaagccatattaacagcaccatcagccataaactgggcgagatcgaacaccaaattgataaattaaaagaagcgaaaagagagatagaatctctgcaggaagagggcgtgtctgaaatcagggacatcctcaggccgcacctggatcatcattggaccggcacttttgctgaagaatttgatgaccggcgcgatcaggcccatacagaagcatacagaatcgtcacagacaaatacgacggttatatttacagaatcggcttaaagatgacacagcttgaaattgaaaaaggagggctccttgccgccagaagcatcgcgagagaggcagagcacctgctgacgctgggagaagaagcccttgacacggtcggagaaaaaatacaatcaatcaaaaaaagctggagttggttttaatggcagaaataaaactcaaatacggagccgtcatgaagcagcttgaatccgtcagcagcgctttggaggccgtttctatcgggaacgccggtacaaacggaaaaaacaagctcgactatacctccaaataccaatcccgcgaggcaaagcttgtatcgatgatcagcgaatacaagcaggccgttcataagaacatagcggacgttaaagacaacgtagattctttgaaggaacaggacgaggcgatcgctgtaaaataacgaaagaaaggacttgccgatgagcaaagtgtttgaatcacaatcgttaacggacgaagcagataagagaaagaaacaatacgaagcccttgaagaacagctgcgtgcgctcaaacaagcctttcaaggcgtggccgatctgggtgatgctttgaaagggaaaggcgcagacaatataaaggatttctttcagggacaagcggaaatcgccgacagctggctgacgcttgtctctgctcaaattgcgtttttaaatggcatttcaggtgacattaaagatcaagagctcagtgattcatatgcggagacttcatttttagagcatgagctgcccaatgcggatttgagagcttcagagattgtctccgctcataaagcagaaatcgattcgattttgtctggcatcagtgatattattcatctcgatacatatacgctggatgattacgcagataaaatgggtgatgcccagaaaaccagacgcgacacgatcacggcagtcgatacgcttgatgaatccctgaccgctgaatatcaaaacttagaatctctggacaacgcagtgctcagcaaatattcccttctcatgcaggccaccagcaacgggaaaagcgcctcccctatgtactatgacaaaaaagccttccacagcaatgaaatctacaaaagcgtcatggcgacagaaaaacagggcacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggtgttgatccggtgaccggcgaaaaactctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgacagaaatgggcgcatacggcctcgtcgcctcaaacggattcacagaagccgtcacaggacgggatatgttcggaaacaaagtgtctgaggaaaaacggaagcaaggggcgctggaagctgcgctgagtttggttggagccggtgcattggcgaagcatgtaaacaaaggcataccgcttgcaacccattcaaaagttcaaaaagctaacaagacactagaaaaagttaaacaattcaaagtcccgacaaacgtccgcgtgtacgcagaacgcccagtaacagcgaacggctttacgtacggattcccaacagtccgtgtcgatgtggaaaagacggctgttaaagaacttgggattgtgaagatggcgagtagccagtcaaaaaaaccaaaatggttggaaaaacctgaggggatgactcaaaatgattatgttgctcataatggtactaactacagtaaaaagaaacggactgaagaatacaatgctgcgctagctgataaagagaagatagttggagacaattcaaatggatatcgtttaaaagaaccaactaactggatggaagaaagaggtatgatacaaataaaagaaagattaaaaagaaaatcttggtcagatagagatgggtttaattggcaatgggattcccagcatggtaaattagaaaagtggaaccgcagaagaacagagcatttaggagagtttgatcctgtaactggtaagcagacgaaaaaaggcgagccttcaagaagatgggatggttaaaactatggaacatggaatcagatttattaatgaataccctgaaatcggtgaattgcttcatcgtctatttgtgaatagggaattagacgaatggtacaagagcaaatgcgcagagaaaataaaagtacctgatgaatttaatcaaataaaaggtttgaaaaaaattgaagttagagatttaaacaatccttcaggagaaattgatatccatttgcaagatctttctggggaaaatggttttcatttagaacagcaaatcaatatgaaagtatctaaattggttcctgtttatgtattagattatagttattccctaagacacgatttaatagatggcgcttatgacattgtaggaaccgctgaatctttagaattcattcagggaacgaactatattaataaaataatgcaagagaaagggtttatcgaactcagttatttgtatgattactacgatactgtgtatgagtggagtgaattgccacatatacagcctttcaacaggagattaacattaggagatgccttgtttactgatgtattagaattgctatagttaagagcttgccttgttgttatcggcaagtttttttataataatttaacaatgtggagtacaaggagaagcagttatggatagagaccatatttctcaattgctgccattaaaaatctgtaatggctggtctgtagtactgaacaatttaagttcagaaaaaagaatgcaagaaaaatatgaattactaaaactacaaaatgaaaaacgtaatgctgttattaaggtaatatttgaaaatgattaataccatgtcatagtagcgggcttaaaaacagataagatttataaagaagactcttttaatgaaatagaacaattattggaagagttggaatatcaaatctggactgtgggaagtggggttttagagggtttgcagcacctaagccaacatgttcccaatttcttaaggcttaagataccagcggggtggactgttgattatattccattaaaagatactgaccctaaaactctagaggaaaatgatgatgcttggttatttgactttaatcaagatctcctgcagtttctcataaaactaaaaatttgctgcttgtagggtggtacccagaaggggatccaaccggcagttatggcattgaactgataaaaaacaaagattgggaaaatcctttagaagatattatgtgtactgaacttaaagaattacttaaacaattggatcttatttttatgaaagaaatgaaaaatgaattttaataaaaagcagattatactatctgcttttttcaatgaagcatatggagtcttcgctagatcgaaacacaggacgattgagcgcgaagactattttaagagaggaaaacaagtgaaatgaaaatacatcaaattcacgattttgaacaaaaagatgaatcggattttattcgaactcaacaatctcttatacataaaatcaacctatcccccgtcatccatccagactccgtcaacaccagcgcaggcgtcgacctcgcttattgggagcaggacggggaaccgtacggggtgtgcagtatcatcgtgattgacgctgatacaacagaagtgattgaaaaagtgcacagcatggggaaaatcagcgtgccgtatgtgtccggttttcttgcgtttcgcgagctgccgctgatcatcgaagcggccaaaaagctggagacggagccggatgtgtttttgtttgatggcaacgggtatctgcattacaatcatatgggcgttgccacccatgcggctttttttctggggaagccgacgattgggattgcgaaaacctatctcaaaatcaaaggctgcgattttgagatgcctgaaaatgaagtaggcgcctacaccgatattctcattgacggcgaggtatatggctgggcgcttcggacacggcgggacgtgaagcctatcttcttgtcttgcggacataacattgatttagaaagcagctatcagatcacaatgaaaatgatcaatcgagaaagcaggctgccgatccctgtccgtctggctgaccttgaaacgcatgttttgcgaacgttttatcggaaaaatcacatgaaacacttggagctctaagccaccaagtgttttttttgtatgcctggtgtctgctttaaaaaaccttgtcgtccttgcagcaggtttttatttgaatgtttttcgcgtcaaatcgataaatgcctttaatggcgcagacatccacttgtccttatgccatgctagttgagtaaaaacggggcattcattctgccagttgagttctttcatccgtccttcggcaatatcgtcttttactgtcatttcaggcaatagtccgattccgagtccggccatcacgcattgtttgatggcttctatgctgacgaattctaatttattagggtagactccggcgtcatgtaaagtgttctcaaagagcgtgcgatatgaacagccgtcctctgtcagcagaagggtttcattttgaagatccttcaatgctgctggtgagtctgctggaaaaggatggtcattggcggctaccattttgatttcatcctgaatcagagattcaacgtgcagtgcgtcttccgaccgattcacatccaaaatgaaagtgatatcaagctggccctgcaagagctgttctttcgcttgttcgttggaaatatacggtttgaatataagctttacttgaggaaaagcctgtttgaattcttttatgataggcggaaggcggtatgtgcactggctttccgtcgcgccgattttcaaggttccggttgtttctcttgcttgatttgcggccatttttgcttcttctgttaacgcaatgatcttctccgcataggatttgaacgttttgccggcttctgtcaggaaaagccgcttgccgagccgttcaaataaaggagtcccgatttcttcttccagtgatttgatctgagaggtaacgcttgattgtgcatagttaagcatcttggcggttagggtgaagtttacgtgttctgctgcggtaataaaggtgatcagctgcttcaattccatttgatctcgccctttctaaatcggttttatcgattggaataatcgaaataatcatctgtattgattgatgaatccattatatgatgaagaaaatcattcgtaaacaaaggagcagatgcatcatgaacattgcggttattcatggcggaacgaggcctggcggaaatacggatattcttgcggagaaggctgttcaaggattcgatgcggagcacattcatttgcggaaatatcggatccggccaattgaagatctgcgtcacgcccaaggcggctttcgtcctgttcaagatgactacgattctatcattgagctgatattaccgtgtgatattcttgtattcgccaccccaatttattggtttggcatgtcagggacattaaagctgtttattgatcgctggtcacagacgctgagagatccgaggtttcctgattttaaacagcaaatgtcagcgaagcaggcatatgtaacagcagtgggcggagacaaccctaaactaaaagggctgccgctgattcagcaatttgaacatatttttcattttatggggatgtcctttaaaggctatgtgctgggagaaggcaatcgtccgggtgatattcttcatgatcaacaggcgctgtccgctgcgagccgtttattgaaaagaagtgatgcgatatgaagctgctgctggttatctctggtatgttgattcttgcactctttctagcttggaaagcgccgacttctgtttggatacaggctgaaaccaattcacctcaggttcagcaatctgtgagaatggcaggcgcaacgctgcaagtcaagcaaatcatcaagagtgatgcaggcgaagaaacagttgtcatatcaaatggtatttccgggccaaaataaaaaagcacctgtccaggtgcttttctttataaatgaggaatcacaagccctccatacaaaaacgccgcgataatcagaaaggccggatgcatcttgaattttgtcaagacaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggggattggcggaagcgctgaatgacgcgcaagaggatgatcaatgcgagcgccgacggtacgacggtggcgatcagcgcaatcaggaatccgggccatccgcctgcgctgtagccgacatacgccgcgattttggttgcgatcgggcccggcaatgcgttcgcaagtgcgagcatatttgagaattgatcgtttgagagccagctgtatctgttgacgacttcttcaaacatcagcggaatcgacgccggtccgcctccatatccgagtacgtttgcgacaagaaacgccataaatacataaatcaagatcatgaggccggcattcctttatcttttgaacgtttctttgtgattttgtcctttaatttaaaatgaaacgcgccgtatgccaagaaaatgataatgacaaagccgggattgatctgtaacgtttgcaggccgataaaagcgatgataaaaaacaggatgcccgtgacccagccgaaacctttaagcgctttttggccaaactcgtacgccatgatgccgagcatgacggcgatcaccggtgttacggcgccaatcatgccggcaacgattgctgagcggcttaagacattgacagccgcaaacaagcccgccatagcgagacatgtaggcagaatatgtgcgagggttgccgcgattgcgcctaacgtgcctttcagcttgaagcccagatacgcagccatttttgtggcaatcggtccgggaagcgcattagcgatcgctaatatttctccgaattcatcatcatctatccatttgtatttattgacggcttcatggcggatgagcgggatcaccgacgggccgcctccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatatgataaaggcttgtcaccgccggctccttttcaagctttaatgcggtttcctccaaatactgcggctccacctccacgttaaaaaacacggacacatgacggccgattttcgccgggttgatgacagcggtgaatttttcaatcacaccggcatccagtaaatgctgaatgcggtgctgaaccgccactcgcgacaggttaacccgctttcctaagtctgtataggaaatcctcccttcctcgtgcaaaatcgagagaatctgtttatccgtttcatcaaggacaagattcggaatgctgtactcatgttccaaccggcttcaccttccttcatttggtggatattattgtatcatgaaatgttacggtatgaaggggaaatttttttattgttttcgttacgtaataacttaggattatttcttatcggaaagtaaatagtgtgtgagcttttctttcaggaaggtggataccggtgaagccgctttttatacttaggaaaatttgtaaaggggcttgccatgaatacttcaaccatcggaacgaaacaaatggtcgtcagtccgcattatcttgcttctcaggcggggccggcattctggaaaagggaggaaacgcgtttgacgcggcagtggcggtcagcgcctgcctggcagtcgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggccagaaagcgccattaccgttccgggaatggcggacagctgggatgccgtgctttcggcgtacgggcgtctttcgctcgctgaggtgctgaagcctgctcttgattatgcggcaaacggattcccggtgtccgccgaccagtgcgcccacacagaacgcaatctcgctcttttagcctcgatgccttacacctcggccatttttacgagaaacaaaaaagcgcccatgcccggtgaacggtttgtccagaagaatctggcggccagcttggaacagcttgccgagaaaggcagaagcgctttttatgaaggagatctcgctcaaagcatcacatcctttctgcaaaacaacggcagccgtctgacacttgatgactttaaagcccaccgcggcgagtggacgaacccggtatcctctgattaccgcggataccgcatctatcaggctccgccgaattcacagggctttacaggcttaatgacgctcaatatattggaaaactatgatttttctcagattgaacacggctcctttgactattatcatctgctgatcgaggcgctgaagaagagttttcagcaccggaatgaagtgctgactgatccggcattttctcatattccgctggatcggctgcttgataaacggtatgcaaagcagctggcggaagaaatcggtgacacggctgcgccggcgctaagccgtccggtcggaagcgacactgcttatgccgccgtcagagatgcggaaggaaatgccgtttcctttatacagagcctttattttgaattcgggtcagccgttacggcgggggagacgggcattctgctgcaaaaccgcgggtcatttttttcgctggatgaatcccatgtcaatacacttgaacccggcaagcggacgttccacaccctcatgccggcgatggcctgtaaagaaggaaagccgcacatcctgtacggaacccagggaggagaaggccagccgcaaactcagacagcgatgattacgcgcatcattgattacaaaatggacccgcagcaggcgatcaatgagccgcgctgggtctgggggcggacatggggagaggagtatgaagggctgagggttgaaagcagaatcagccctgaaacgagagaagccttaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagcatgatacgctaactgatgaaaaaaataagcacgccaagagcggcagaaagacctgcgtaaaacgaatcgtacacatattgcttttcctcccgccggtgccgccattccattaagccgctgcagcaaaatagcatgaaaacaactcccgcaaatacgtacatttcattgaacaaagtcaccgctgcgatgcccgtaataagcagtgtgatttcgattaatcgatgtgtgccgtttatcggcttctgctttttaacagcctttggaaaatgaagaactttgacggcaaatacttgaaacataaggctgagcaaaataaatacggctgaaaaaatcagtaactgaatgaaatccatcgtctcctcctaaaaatgtcactcgtttcatatgggtgagggccttgtaagtttcagcattctataagacattaggctgagtttaatggtaaaagactcaaaaaagacccctttcgaaaggggtctttttgactagtttcttctattataatggttcctgcttcaggtcgggcggacaagcgtatatgtcttcccgagtctgacgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttgaaacggaagatggcgttcgagtatacattcaaacctgacttttgcttcttttataccgggaacgctgatgcaggcgctgtctgtcacagaaaggtctgtcatgccaagttcactgacatcaggatcaagccttgccgccgttttgttaatgtcttcaataatggactcatcactgacgtgcaccacgaattcccgatgagcgattgcgtttctcgcggtgtctttctgccgtccgtccgcgcggctgacagagatggccagaagcggcggttctgcggagacaacgttatagaaactgaagggcgccgcgtttacggcgccgttgatggatgaccgcgtcgtgacaaatgcgatcggccggggaacgactgtgcccgaaagcaatttgtaggtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacaaatggcgttacttgtagtttttctttacaacccagatgttcccgtctttccagtactctgttttgctgcagtaatcgtcttttttgcaagggtcttttttatgaggacggtaaggttttttctgcgtgcgttttttcttgcggcggcatgattttttgtggctgcgagattttttgtgagaacgggattttttatgactgcgagattttttgtgagagcggcgcgattttttatggctgcgagattttttgtgagaacgggattttttatgactgcgagattttttgtgagaacgggattttttatggctgcgagattttttgtgagagcggcacgattttttatggctgcgagattttttgtgagagcggcacgattttttatgactgcgagattttttgtgagaacgggattttttatggctgcgagattttctcttcttactgctttttggttcttggtacaaataatcttccaatccctcggtgcttgcggactttactgcttcttcgatatcagaatgggaatagtggcccattttgaaacctcctcatgatatatgttttaaggatgcgatccttactaccacatagtacgcatgaatgaaaaaagtgtatgtgtgattcgctgagttttatataaatagcacagcctaaattaatacagggagggttactgatgaaagaccaatcaacattgcctctataccagctgtttattcacccgaaagacttaatggagctgaaaaaagacatttgggatgatgatccggtgcccgcggtgctgagagtgaatcaaaaacggcttgacattgatctggcgtaccgcggctctcatataagagattttaagaaaaaatcgtatcacatcgctttttattcgccgaaaacatttcgcagggcgaaagagatacatttaaacgctgaatacaaagatccgtcgatgatgcggaataagctgtctctcgatttcttcgcggagcttgggacgctgtcaccaaaggcgaatttcgtaaccctgcaaatcaatggcagacatgagggggtgtatcttgagctggagtcagtggatgaatattttctggcgaaacggaatttggcggacggggctgttttttacgcggttgatgacgacgccaatttctcccttgtcagtgatctggagcgggatacgaaaacatcgctcgaacttggttatgaaaagaaaacgggaacgaaagaagacgatttatacttgcaggacatgatctataaaattaataccgttccgaagtcagagttcaagggggagatcgtcaaacacttggacgccgataagtatttgcggtggcttgcgggcatcgtgtttacctcaaactacgatggatttgttcataattacgctttgtaccggaatcatgaaacgggactttttgaagtcattccgtgggattacgatgcgacgtggggaagagacattcacggtgatcggatggaggccgattatgtcagaatacaagggtttaataccttgactgcaaggcttctggatgaaccgtatttccgcaaagcgtacaaacagcttttggaagaaacgcttcagacccggtttaccattgaacatatgaagccgaaggtcatgtcactgtatgagcagatcaggccgcatgtcgcaaaggatccttataagaaagaggagattgattgctttgaccgggagcctgatgtgatttgcgaatacattaaggagcggtccgccttcatcagcagtgagttagagcggtggaatatctgatttggaaatgaagaaagattttttacaaataggctggtgaatcagttcccgaaaataatcgtgatacgtatatatgcattatgctttttacattatgagaaaaatgactaggaggacaatagatgaaacgcaatacgaagcggcatcggtctgatgacaactttttgcatgcgatggaaggaaaagtaattactgtctaccggggaggcccggagtccaagacagggagattagcagacattcaatcggattatatcgctcttcaagttgataataaaatcgtttattatcaatggaaacacgtgaaaagtgtgacggaaaatacgagtgaaaccgtatcgccggccgaagcggcagaatgtgaaaaagctgatgattttcaagatctgatcagccggatgaccaatcgcacggtgcaattgaatcagggaggtccggaatcgaaaagaggaaagcttcacgaaacaggggatgattttctcgtgctggaaacagaagatgacggaatcgtatattttaacgccgatcatgtcaaaagcatcagcgcggaacaagaagaggacggccaggaggaggagcgcccggaatttgaaatggctgatgattttcacggcatatttaaacgcctgatccacaaatgggtatccatcaaccgcggaggtcctgaagccgttgaaggtatacttgtggataattccgacggccactacactcttgtgaaagataaagaagtgctgcggatctatccttttcatatcaagagcatcagcgaaggggcaaaaggagcagccaaaaaagaggagaataaagacgacgagaataaaggcgggaaagagagcgccgaagaagaaaagtcacatgaagaagaatctcgcgaagagcagcgtacttcctctaaaaagtcgaaaagatcgtcaagatccgttcgatcctcaaaacgggaggaagagaactcttatagctacgccactgtattaaggacaatagattataggtggaaacacggccgtaaatgattggaaagattgtccgtaaacgcgggagaggggggaatgaaatggctggattaagcagatttcttgataaacaagtcgatattgagatatcggggaatacgacattttcaggaactcttttggatatcggtcaggatatcattgtgattcatgacggccggacgtttctttatattccgctgctgcatcttcagaggatgacattgacgctcccggacgaagagaataaagaaccgtacgcaagaaaaaaaagtccgcatcccgaaaaacaggaacattccttttcttaccggaataccctccagcatataaaaggcagatttacagaaattttcgttacgggagaccgttccattcatgggtatgtgacaagtgttttaaatgattattttgttttcttctctccggtttataagactcttttcatctcgatgcatcatttgaaatggctgacaccctattccgatgagcagacgccgtatacattaaacagttcagagctgccggttgttcccgctaatgtgccccttgtccggaattttgaggagcaattaaaaagatatgtcgggaagctgattattctggatttaggagatataccgaataaagtggggctgttacaggacgtctcagataatattcttgaattgaccaatgcagacggggatactgtcttttggaaattgaatcatttaaaaaccatgcacctgccataaatgataaaactgcctctcttatacagcaggcagttttttttcatagctaaaggtaaatccagctgatccaaacatataaaacggtaatggtaaacacgacggtgagagggacaacgacaatggtcgttttgatatattctgaccaagaaactttttcgccgtgctgtctgatgatatgcatccagatcagtgtggctaatgtcccgatcggcagaagcaatgatccgatatcactgccgataatattagccagataaatgatttttacggttaatgggtcgatggacatttcagttaatgtcaaagtgctgatcattaaggcgggatggttattgaacaaattagagaggacggatgtagcaatgcccataatagatgcagcgtgggcaatgctttgtgagacataaggctcaatagactgaacaagcaatgccgtcagtccgatattatgcagtccgtaaatgataatgtacatcgtgaaggcaaaaataaagatatgccaaggcgctttccttaataagtccgccggtccgatttttaaataaaaccatctccagcaaagcaggatgactgaactgatgacagccacgagcgaaacggatatgccgttgtaagaagctgcaaacagactgatccggacaaacaatacaaataccaaaacacaaaacatgatgttcgtacggctgtttttttgggacaagtctggcggaggctgaagcggatgatatcgtttgtgttccagcgattcaaaatgaaccggaatatcggggagctgtttcggcaaacggcggtagaaaacggcaaacagcagaaaggccataaacaccagtcccagcgtgccggggataaacatcatattggtgtacaaataaaggtccatgcctatcattttgagagaaattaaattgacgatattactgacgccgatcggggtgcttgccgccgtcgcaattaatacgccgcttattaaatacggtgttttctgatgtcttttaagtccgagatattgtaagaccaatagtaaaataggagtggtgattaagacgctgccgtcattattcagaaagagcgtcattgaaaaacagagcaggttggtcagccaaaaaagccggatgcctgatcccttggcgcggtgaagcagtttggccgccgcccagttaaaaaaaccgaagctttccagcgcgatcgccattatcattgtggagataatggttattgatgctccggtgacttttgaccctatatcccccaaatcatgaaaggaaacggttccgcataacaaaacgagaatggcgcccagcgacgccggaacggcttcatttaatcccccgggtctccaaaatataaaaataatggtcacaaagaaagaaatcagggtcaaaatgacggtaatatgtgtaatgtgttctgcctccttttcgatgggtcattgccgccccgttatttttatccctcctgatcagttgtactgtatgtatacgggtacaggtcgtaaggtgtactgagcgtttctaccaatttagtaaaaatccataaaagcacaaaaaaaagaggctgctttcggcggccctcttttttatgcattttccttatccgcctgcaataaagcctggcgcttattcataatatccagaaaatgtttcaggatcggattttgattatccttgcggtaggcaatgacccattcggcagtgagctgcgcctgattaatgccgcggtaggcgacttcgagattaaacagctttttagcagaagaaggcacgaaggttacaccgataccggcactaaccaatccgatcaccatttgatactccgtcgcttcctgaacgattttcggtttgaagcccgcctgctcgcagtagtttacaaactccaggtataaagtcggccatgtttctttcgacagtgtgataatcggttcattttttaaatcctgaatgtcgattgtctgtttagcggtaagcgggtgctgcttcggcaaagccagaatgcacgggctgctctgcaccttttccatatgtaacgcggaatgttgtaaaggcggatgaaggatgccgatatcaatgttccccttcagaagttcttcctgctgtctgaaagaagaaatttcacgcagatcaagcttgacggaggggaatttttcgcggaattcccgaatgatcggcggcagaaattcatatgtggccgagccgacaaaaccgacgacaaggcggccgagctctccccgcgccgttctctgcgccatttcaatcgctttgtctatttcttcgatcgcgtttctgctgtgttttaaaaaactttctccggcagctgaaagctctacaacccgtttcgtgcgctttaataaggtcacgccgacttccttctcaagctgtttgatctgctggctgagaggcggctgtgtcatatttaaccgaagcgcagctttgccgaaatgaagttcttcggcaacggcaataaagtattgaagatggcgaagctccatccttatccattcctttctctttgttaattattcgtgaaacatattaatcatacggcgaattgatattggaggtcaatttccaaagagtgtatagtgaataatatcacaaattacttaaaattttatatttaatatgcataataaggagtgagggtgttggcaaaagcaacaaatgaactaaaaacctctgaaaaaaatcggggggcggagcttgttgttgattgcttagtggagcaaggtgtcacacatgtttttggcattccgggtgcaaaaattgatgcagtatttgatgcgttaaaagataaaggacctgaactggttttatgccgtcacgaacagaacgctgcatttatggctgcggctgtcggaagactgactggaaaaccaggcgtttgtctcgttacttcaggcccgggggcatccaacttggcgaccggcttgttaacggctaatacagaaggtgatccggtagtggcgctggcgggtaacgtaattcgcgcagaccggttaaaacggacacaccaatcattggacaatgcggcgctatttcagccgattacaaaatacagtgtagaagtacaggaaacagggaatataccagaagcggtaacaaacgccttcagggcagcgtcagcaggtcaggcaggcgcggcttttgtgagctttccgcaggatgttgtgaatgaaatcacaaatgtgaaaaacgtacgcagcgtgccggcgccgaaacaaggccctgcaccggaagaggcggtcagcgcggctatcgcgaaaatccagacggcgaaacttcccgttctgttagtcggtatgaaaggcggaagaccggaagcggtaaaacaaatccgcaaactgcttgccaaaacaaaactgcctttcgtagaaacgtaccaaggggccggcacattgtccagagagctggaagaccaatatttcggccggatcggactgttccgcaaccagccgggcgatcttctgcttgaacaggcggatgtcgtattaacgatcggttatgatccgattgaatacgatccgaagttctggaacgtaaacggtgaccgtgctattatccatcttgacgaaatccaggccgatatcgatcatgcctatcagccggaattagaattattaggcgatatccccgctacggttaaacaaattgaacacgacgctgtgacatttgatatgggcagccgtgaaaaagaagtgctgagcgagttaaaacagatgctcacagacagcgagaaggcgccaagcgatcataaatccgacagagtgcatcctctgcaaatcgtccaagaactgcgcaatgcaattgatgacgacgtaaccgtcacttgcgatatcggttctcacgcgatctggatgtcccgctacttccgcgcttatgagccgctgaaactgttgatcagcaacggcatgcagacattgggcgtagcgcttccttgggcgattgccgccacattggtgaatccgggtgaaaaagtcgtatccgtttcaggagacggaggattcctgttctctgcaatggaattggaaacggcagtccgcttaaaagcgccgatcgttcaccttgtatggaatgacagcacatatgatatggtcgcattccagcaaatgaaaaaatataaccgtacatcatgcgtagatttcggaaacattgacatcgtaaaatatgcagaaagcttcggcgccaccggcttgcgcgttgagtcaccggaacagctggcagacgtgctgcaaaaaggcttgaacacagaaggccctgtcatcattgacattcctgtcgattacagtgacaatgtccatttatcaagcgacatgcttccgaagcaattcaaagaaaaaatgaaagcaaaagctctctagcactctgcgcaccatgacctgttttctaaaacagcccaatttaaaaggagtgaagggaatatgaaaaacgcaagcgacatccatatgatgagccgcggagaaaaaggctcacctgaggatcaaatctatcaagtatccaccatgacatctctgctggacggagtgtatgacggagattttgatatggctgacattccgaagttcggtgatttcgggatcggcacgttcaataaactggacggcgaattaatcggatttgacggcgaattttaccgtctgcgcggcgacggaacggctacgcctgttaaaggcggagacctgtcaccattctgctcattcacatttttcacgccggacatgacgcatacgatcgacggcgaaatgacccgtgaagaattcgagcaggaaatcgccagccttctgcctagtaaaaacttattttatgcgatccgtttagacggcgtatttaaaaaggtgcagacaagaacggtagaacgccaggagaaaccgtacgttccgatgattgaagcggtgaaaacacagcctgtgttcaactttgacgacattcagggtacaatcgccggcttctggacgccgggttacgcaaacggcatcgctgtttccggatatcacctgcacttcattgatgaaggacgcaattccgggggacacgtgtttgactatgtcattaaagattgtaaagtgaccatttctcaaaaaatgaatatgaacctcaagcttccgaatacggcggactttttcaacgcaaatttagataatccgaattttgcgaaggatattgaaacaaccgaaggaagcccggaataaaataaaaaagaaagcctcatttttctcgggggctttctttttatttggctgaaccggcaaagattaggtaaaatacagtcaaaagggaaaggtgtggtagctgtgaaagtattggtattagcggttcatcctgacatggacaactcagcggtcaataaggcgtggacagaagaattaaaaaatcatgatgacatcacggttcgtgagctttataaagaatatccggacgggaaaatagatggggaaaaggaacggcagctgtgtgaacagtatgaccggatcgtatttcaattcccgctgtactggtacagtgcgcctccgcttttaaaaacatggatggatcatgtgctggcgtatggctgggcttacggttccaaaggaaaggcgctgcacggcaaagaattgctgctggctgtttctgtaggtgccggagaggatgcatatcaggcaggcgggtccaaccatttttcactgagcgagctcttaaggccgtttcaggcaatggctaattttacgggaatgacctatttgccggctttcgcgatgtacggggttagcagcgccgatgctgcggctatccgtgacaacgccaaacgcctggcggattacataaagaagccattttagagtcgtatgcattcatcttcatccgacaatatttcctgagaaatatttcgaaccttagacgtttctgactgctcaagaaagaaaaaacggatttcgcgctgaatttgcgaaatccgttttgatattatgtcagtttttgcagatcttttgtgctgatatatcccgttgcgcccccgtaatcgacaagcgcccagccgaaatcaatgccgccgccggctgtctttttccatccgaggaaagaaacgctcgtgtttttggcaagggaagctgtgaccgcttgtttgtctgtatatacttttgtttttgccgtcgtttttacggttgttgcttctttaacaatataatgagtagatacaaatcctgtttttccgtttttataatgtacttttgcccagtcagcgttctggaatgaaacgatctttaagctgtcgcctaaatgaagggtatcagctctcggactggctgctgatgcttttgttctcacgttcaatgcttccgcggaaacgagataagagtcaagcgggtagctgtacagatcgtcaattttgaccgcttcttgcgcgtgtgtctcgggaagaggcgttattccggcagctgaagccgctgatattcccgctgcaagggtcagaatggatgccgctttggctgttttcttcatctgtatctctccttttacttcatcctttcacgttttaccggaagtctaaacatcagccggttatttttgcgtttgaagtttcaatggagcggaaatggtttttttgactttttttcctttgagcacctgctccgccgcttcggccgccagttttccgatcagctccggctgctgggcgaccgtggctgtcagcttcccgcttttaatggaagaaatcgcatctttatttccgtcgaaaccgacgaccaaaatgtgtttgcccgagctgttaatcgcttcgagcgccccgagtgccatttcatcattatgggcgaacacggctttgatatccgggtgtccctgcagcaggttttccatgacggtcaatccttttgtgcggtcaaaatctgccgcttgctttgttacgacatccagctttttgtcggcaatatgatgaaagcccgttccgcgttcccgtgtcgcggatgcgcccggcaccccttgcaattcagccactttggcgccttttccgagctgatcggcgaggtagtcagccgccatttctcctcctttgacattgtcagaggcgacaagcgtttcgactttgccgtgttcggctgaacgatccagcgcaatgacgggaatgccgagggaatttgccgattcgactgctgttgaaatcgctgatgaatcggtcggattgatcagcagcgcatcgactccctgctggatcaaatcttctacgtcatttgactgtttagatgaatcattttgggcatcgacaataatgaccttcatgccccgttttttggcttcctttacaacgccttcttttaatgaaacgaagaacggattgtttaatgtggagacggagagcccgatagtgaattcttttttatgttttgtgtttgacggttttgcccattgcggcggttcaagtgaacaggcggacagcaaaaacagtgataatgccgcgatcgtgatgatggctttcttcataatggtcctcctactatgccgattttttgcggtccagcagcaccgcgattaaaatgacgattcctttgacgacgagctgataaaacgatgatacgccgagaaggttcaagccgttgttcagcgtaccgataatcaaaaccccgatcagcgtaccgatgatgcgccctcgaccgccggacaggctcgttccgccgagaacgaccgctgcgatggcgtccagctcgtatgattctccggccgtcggctgtgcggaatttaagcgtgatgtcagaatcgctcccgccagcgccgataataaacctgtcagagaatagatcatgatcttgatgcggggcactttgattcccgatatcagcgccgctttctcattgccgccgatggcgtatgtccggcggccgaacggtgttttgtgcagaagaacccacagggccgcaaatgcaatcagcatcgtaatggcaggtacggggatgccgagaaaataaccgcgcccgaataattgaaatgcgtaatttgaaccgagccccgtaatcggatttccgtccgtatagacgagggtcagtccgcgaaagacggtcattgtcgccaaagtggcgatgaacggcgccatttttccttttgtgattaataatccgtttatcatgccgagtacggcgccgatcacgcagccgatgatgacggctaagatcgggtcgatgcctgagaccatcatacctgcgaccactgcgctcgataaggcgaggatggctccgacagagagatcaatgcctcccgttaaaatgacaaacgtcattccgaatgcaatcagagcgttaatcgcaacctgccgaagaagattgagaatattgagaggttcaagaaaactcgggtttaaaacggaaacgatcagcacaagaatcagtaagccgagaaacggaccgagtttttgcgtgaaggtatgaatggaaaatcgcttttgttcagttgatgttattggttcagttttcatactgctgccctcccgtggcaagtgtcatgatgtgttcttgtgttgcatctgccgcattgatttctccgctgatgcgcccttcgtggacgacgatgattctgtcactcatgccgagaatttccggcagctcggaagacaccatgatgatggcgactccgcgatcggtcagttcattcattaatgaatagatttcccttttcgcgcctacgtcgacgcctcttgtcggttcatcaaggatgaggactttcgggccgattccgatccatttggcgatgacgactttttgctgatttcctcctgataaatgccgggcggcggtttccggagatgcagtcttaatggtcagacgcttgatgagcagctcaacgaactccgcctcgcgttttcggtcaatgatgcctttcggagagaagctggtcaggttcggcaatgagatattttcacgaatggacgtatccagcagcagcccttcatctttgcggttctccgtaatcaggccgagtcccttgcggatggcatcgtacggaccccgaatgccggtttttcggccggaaatccagacctctccggaatcgagccggtcaattccgaacagcgccctcatgatttctgtccgtccggcacccattaagccggaaacgccgaggatttctccggcgctcacatggaaactgatctgtgaaaatcttcctttttttgaggcgtttttcacttcgagcaccttatcgccgagtgacggcgtgcgggtcggataccgatcggtcagctcccgcccgaccatttttttgaccacttcatcaaaatgagtatctttcatatgcgccgtatcgacagtgaggccgtcccgcataatggtgatccggtcgcaaattgaaaatatctcttccattcggtgagaaatatagacaatggatacgccgtcccgctttaacgccgtcatcacgtcaaacagtttgctgatttcccgttcggtcagcgccgcggtcggttcgtccataataatgacttcggcgtttgtcatcagcgctttggcaatctcaatcatttgctgctggccgacggaacattgtccggcttcccggtcaagaggaagagagactcccagtttttcaagctgtgattttgctagcgctttcattttcttcgtttccaaaacgccgaacgccgtcgtcagctctttgccgataaaaagattttcaagcaccgtcatgtccggccatatattcagttcctgatggataaaggcgattccgtgcttttcggcttcctttggattggagaaattcatatttgttccgtttatcgtaatgtttcccttgtcgagccggtagagcccggtgagcagattcattaacgtcgatttgcccgctccgttttctcccattaaagcgtggatttctcccggcagaagctcaaatgagacgccggatagcacttggtttttgccgaatgctttatgaatgtctgtcatgccgatgtgcatgctggatcccttctttctagaaaatcacacccgcctgcaggatgcagttggcgtatggtgtcatttcacccgtccggatgacggcttttgctttctgtgtgagccgtttgaattccgagtgggacatgtactcgatcgtctgcgctgagaaatggctttctatgaaacttgcattctcaggattttcgtctttgatctcggaggcggccatcaccttttcgacggccatctccccggctaccaggctggtcacatcccgaaaggcgggaatgcccgccgttaaggacaaatcaattttagggacgccgtcagggacggggagacccgcatcggcgatcgcgatgaggtctgtatgcccgagatcggctaatactttggcaatgtggctgtttaacattccgtgttttttcatgacagcagctcctcaacttcttttctgaccggcatcccgccttgggcgccgaagtgctgcacggacagggaggcggcgcggttggcgaacaggagcgcttgctcgatgtcccgtccttccgcgagcgcgacggcaagtgccgcattaaaggtatcgccggcacccgtcgtgtcgaccgcttctgcagggaagccgggaacaagccgttccgcggtgccgtctgagtagcgtacgccttgttttccttcggtaatgaacagtttgccgggatagccggcgagcgcttcttctttcgtccggtcaggaaataaaatggatgcttcatgttcgttcggcgtaagatatgcggcattctcaatcgtcgattgtttcagcgggcgggccggcgcgggattcaggataaccggaatttggtgcgcgcggcagtagctgcacacttcttcaacagtttcttcaggaatctcctgctggatcagcacgatatcaatgccgggaagtttttccagcgcacttttggcataatcgggtgagatgtcatcgtttgcgccttttacgacgacgatgctgttgtctccttctgcgagcacaatatgagccgttccgctttttttatgtgtaaccgtttccatatagtccgtattgacaccgtttgccttcaggttttcaataatcgcttttccgtagctgtcactgccagcttttcctaccatatatacgtttgcgcccagacgggaagcggctacggcctggtttgcgccttttcccccgggcacggtttgaaagtctgtgcccagtacggtttctccggctttcggacgccgttcggatgtgacgaccagatccatagaacagcttccgataacacaaatttcactcatggtgatcatcctttctcgtcgtttgtcttcttatataagtcacgggcagttgaatggccgtctctttcggcggctctttctttatcaattgcagcagcaggtttgccgcttgttttcccatctcatatgcaggctggcggatggttgaaagcggcggaaacaaaagcctgctctgcggaatatcgtcgtatccgatgatctgaatctcctccggaacttttttgccgagccgcagcgcctcatggaggacggcagccgccgcaatatcgttgctggcaatgactccgtcggtttcggggtatgctgcaaacaatttttctgctaaaacggcggcatccttgatagaaaatgaagcggcggagatgacattgaactgcgcgcccgctttatacagcacatcaagtgcgccgttaaaacgttcctgagcggtcggaaggtggcctgggcctttgacaagcgtgatgcttgtgcttttgccgcgaagcatttcctcagccgcccgttttccgcctgcccgcccgtcactgaatacggatggggcgccttcttttgtccggtccagaaatacgaccgggtaaaggctgccgctgtattcgggaaggtcggggtaatgggtggccgccaaaataccggcaacttgattttgtttaaatgtttgcaggtagtcgagttctttttccaattcttcatcgctgttgccgatgatcagccggtatccttcccgctgcagctcgtcttcagcgccgcgggcaagctgcgggaaaaaggggttcgtaatatccggaagcaaaagcccgaccagtctggattctcttttataaagagagcgggcaacttcattcggataataattcagcttctccatggcaagcatgaccttcgttcgtgtatcttcatggacgtagccgttgtcattgaggacacgcgagaccgtggcaacagagacgccggcagcgcctgcgacatctttaatcgttaccaacaaacactcccccttcatttatgtaaccgtttacacaaaaagagtaccacgaatcatttcggttggcaacaaaaaaagagaccggggtctcttttagttcacgatgccgatttgcgagatattcactttgatatcagggattatctcgatggaaggatagacctcacgccaattgagccgcttgccccgctcataataatgggtttgatatttccggccgatgccgaggatatccgagttgtgctcctgaatatggctgatcaccgatctggcctggctgttcaaatttgctgatgcttgtttgttcatttggtcgattgccgtataagaattcagtttgtccttcggatattccaagacgcgtgcattcagctttaaacggattttcacttttatatgctgcggatctgtatctataaatacaatctttcgcgtggcatccgtgatgccgagagaaagataattttcaatatccattttgtatttgtcccacagcttcagattaatattagccgatttattaaattgcccgcttaaaagggtcaggagggtcgaatcctgaccgagcacctcagtcactttccgctgtccgctgaacagggcagaaccctctacctttatcgtctgtccgttaatcgataaataaggaagggcgaaatccttatcagccgtcagcatgcttgaacggatggattgcaaattttccatgctgatatttgattccgcattagcgcttgttaataaattcgttaaatacttgctgacgatcaatttctgccggacgatcagcttcagcacttcaatcgcctcgccgtcttttacaaccgccggatgagcgagaagcggacttttcggatctctgtaaaagacatcgagataaggaaaaagcggtttttccgccattttctcaccgattaataagactctttgcttggacgtgtcaatgcgctggtcgacaagcttatccaattgaaaccgcgcttcacggatggtgtgtccggaagcgctgagcaccgtcgtaatgaatgagccgcccgtttcctgttccgcctgggaggactgaaccttccgataggtaatgccgattttatttttaccgtcatgatcaacatcaaggcttgcggtcagcacgagagaaatatctttcaacaaattttgatcccagcagccggcaagtgtcaggcttgcgcacatgagactgataagaaccgcttttttaatgcgcatggcggacaccctttttgcgtacaaggacaatcaataccataaacaacggaaacaaatacacaaacacaatatcggaaatgcggaaaaactgatccagctgctgtatcgttttatctgtgcttgtggcccaaatagacagaaggaagacgagcagggccagcggataaacaaaccggctgtgatctttttgattgaacagcttggcgatgccggtgcttgccaagtaaaacacgttggccagcgttgaaaagacggtcacgaaccaaaacgtcaaaaagagcagatccgtccgttcgataattctgaatgaaacggtttttaacaggtacagcacaggctccgggatcatttttatttcttcggggctgatggtgacaaagcaagtaagagtgatatacaggtaataaaggataatcaagccgtttgaaatcgtcagtattttgtagcgctggctgacggtgcagttgataaggggcccgatcacaagcgccgcctgaaagccggtaatgctgacaagtgtttgctgcaccccggtaagcatgtcttttgcggttccgtgaaaaatcggcataatgtatgtgatatcggcttttcccagtgtgtataaaagcggcagagagatcagcagcaaaaacggcgttaaaataaagctgaacctcgcgatcgcattcagcggggcttgggcgatatagacagaaccgaggatcagcattaagctgatcacccaattcggagtctgagggagcacccagatatccaataaccgtgtaaatacagaaagaatgagcgtgcagagaaacgcgaaatataaaatatacagcacctgcacccctttgccggcaagtgttccgaacacctcctccagcatttcatacaggttcagcttcggaaaccggtgaaataatatcatatacaggctgaaggtaagctggacgagcaatccggtaagcagaatggaaatccatccgctgcttcccgatttcatcatcagtaaatggggcagcgccaaaatgccgatgctgatctgcgtctgattaatgaaaaacacgccttgaagccggctgatttttttaggcttcatcttttctccacccccgaacatgttttatctgctttgaatcttgcggtctcaaataaaaaggccttcttttaataaaccaggccggcagccggataaatgcatcctttaagtcactgaaatgaaacggcgtcagagatgataaatacggaacgccgagggattcaagcttgcacaggttcatcagaataagtccgaagccgaatgcgatgccgataaaaccgaacgaggatgccagaaacataagcggaaatctgagcgttcgaatggacgtgctcatttcatatgaaggaagcacaaaagaagaaacggccgtaacggccacgacgataatcatcatattagaaatgagtcccgcctgaacgactgcgtcaccgatcacgagaccgccgacaatgccgatcgtctgactgatcggtttcggcagcctgataccggcttcgcggatcagctcaatcgtaatctccataatcatggcctctatcagcggagggaagggaatatcaacaatcgaatttttcatggtgataatcaaatcgttgggaatgacttcaaaatgaaacgcaatcagcgcgatataaaaagcgggcagtgtaatcgcgatcataaaggcgaaaaatctcagcactctcaaaaaactggcggaaatccacctcgtgctgtagtcatccggcgattgaaaaaaggaaaagaacgtgatcggcgcaatcaaggccgacgggctgccatccatcatgatcagcacacagccttccatcacgcatgcttttgctttatccggccgttccgtatgaacgatctgcggaaaaatggaaaacgaattatcttctatcgactcctcgataattccgggcgcaagcacgctgtctatacgcaggtatgacaggcgccgcttcacttcctccacaatctccggattggcgatattctcaacaaagataaccgcaacctttgatttggctctttccccgatatccatataatgaacggagagatggcggtcctgtatgtgaaaccgcagctgatgaatgttcgtttccaaactttccacaaacccgtcatgggcgccgcggacgatactttcagattcgggttccataatggaacgcagcggattctgcccgacggaaaacagcttcgctttccttgatgcatcgctgagaaaaacaacctggcctgccaaaatcccgtcaatgagttttctggtttcatccgtttccgcactgctgacggcattcatcgtttcctcaagcggaccgttctgcagggtgtcgcttaacagaaactcattcagcttctgttcttctatcatttgttcaatataaaagaaagcggtatgacggtcctgcagtttgatccttcgtattttaaaatcaccgcaaacacacatcagctcctgcatttcccgtacagccgattcaaaatcgccggaaatccgcttgttttgtttatccgcagacatcagaccgcctcctttcccggttatttgtagttttcagcgggtattccttttttatgcattttataaaatagaggagtttctcgacgttttaccaagaacttcacaattatggatgaatatttcttgaacgaatataaagatttattaaaattatttcaaaagagtgataaatgtcctgtaaatgctttaaaaggagataggctttccgcatataaaatgtgtatttcttgtaaacactccggacccgtctttttctgtcacgtaccagtcattccgctagttattttggaatgggactgaaagcaggatacgggggaaaaatgaatgactttaagaccttatccttaacaaaacaggcagtctgcacacagcggacatagagtcccgaaacgtatgcgcagtgcggaaaacgctgatataacaggctgtaaaagatggattatcattacatctttttcttccggaacgcgtatagtcccattggtccaaatgaatttatgtgcggaaatgtaaacgcatacatttttcttttaaaaaattgaagtaaggtttaagtcctgcctattcccaaaaaaagcaattcgataataggaagaatagcgtcactaatagagaagtttggctcagtgaaagcgggaagattatgttacataatgccgattgagaattcatagtgaagctatatactgatgaatgaatttatcaatacagaaggagatgtcaaaaatcaatgtggttactcattatagcctgtgctgccgtactaatcatcggaatcattgaaaaaaggcggcatcagaagaatatcgatgctctgccagtacgcgtcaatattaatggtatccgcggaaagtcaaccgtaacgaggctgacgaccggaatactgatggaggcgggctacaaaacagtcggaaaaacgacgggaacagatgcaaggatgatctattgggatacacctgaggagaaaccgatcaaacggaaaccgcagggcccgaatatcggcgagcaaaaagaagtaatgaaggaaaccgtagaacggggcgccaatgccattgtcagtgaatgtatggcagtaaacccggattatcagattatctttcaggaagaactccttcaagccaacatcggcgtcatcgtgaatgtgcttgaagaccatatggatgtcatggggccgacgcttgatgagattgctgaagcttttaccgcgacgataccgtataacggtcaccttgtcattacagacagtgaatacacagacttctttaaagaaaaagccgcagagcggaataccgaggtcattattgcggataactctaaaattacagatgaataccttcgaaaatttgaatatatggtctttcctgataacgcttccctggcgctcggcgttgcccaggctcttgggatagatgaagaaacggcgtttaaaggaatgctgaacgcgccgcctgatcctggcgccatgagaatcctgccgctgctcagcacgaaggagcccggtcatttcgtaaacggctttgccgcaaatgatgcatcttctactttaaatatatggaaacgtgtaaaggaaatcggctacccgacagatgaaccgatcgtcatcatgaactgccgcgccgaccgtgtggacagaacgattcagttcgcaaacgacgtgcttccgtacattaaaacgaaggaactcatactcatcggcgagacgacagaaccgatcgtcagagcttatgaagaaggcaagattcctgccgatacactgcacgatctggaatataaatcaacagacgaaatcatggacgtgctgaaaacaagaatgcaaaaccgtgtcatatatggcgtcggcaatatccacggttcagcggaaccattaattgaaaaaatccaagagtataaggtgaaacagctcgttagctaggaggaaaaggataaatgttcggatcagatttatacatttcacttattttaggcgtgttaatcagtttaattttcgcggaaaaaacaggtatcgtacctgccggtttagttgtgccgggttatttagggctcgtttttaaccagccggtctttattttactcgtactgctggtgagtcttcttacatacgtgatcgtcaaatacggtttatccagatttatgatattgtacggacgcagaaaattcgcagctatgctgataacgggaatctgcttaaaaatcgcccttgattttctttacccgatcgtaccgtttgagatatcagaattccgcggaatcggtatcatcgtaccgggtctgatcgccaataccattcagaaacagggattaacgattactttcgccagcacgctgttcttaagcggcgcaacttttgccattatgtttgcttactacttaatctaatgtaaggtgtgtcaaacgatgaaaaaacaattaagctttcaagaaaaactgctgaagctgaccaaacagcagaaaaagaagaccaatcttcacgtttttatcgcgctgccaatcgtcttttgcctgatgttcgtctgcatcctgacagggaaggcggaaacgccgagtgtgaaaagaaatgccgatgaccttgtatcagcctcatttgtcggagatattatgatgggccggaatgtcgagaaagtgacaaagcataaaggcacggagagtgtcttccgttatgcaaagccattcttcgaatcatccgactatgtgtcagggaactttgaaaacccggttacatataaaaagaactacaaagaagcagaaaaaaatatccaccttcagtcaaacaaagatgccgtaaaagtattgaaggacatgaatttcacagttctcacggcagccaacaaccatgcgatggattacggccctcaaggaatgcgggatacggttgaagagttttcaaagcaaaatcttgaacttgtcggagcaggcctcacgctgaaggaagccgagcagaacatttcttatcaagatgtaaacggaatcaaaatcgcaacactgggtttcactgatgtttccggaaaaggttttgcagctaaacgaaatgcgccgggtgtgcttccggccgatccagagctgtttattccgatgatttctaaagccaaaaagaaagccgatcttgtcattgttcaaacacactggggacaggaatacgataatgatccgaatgacagacagcgccaattggcaagagcaatgtccgatgccggagcggatattatcgtgggacaccatccgcacgtgctggaaccgatcgaaatgtaccacggcaccgttattttctacagcctgggcaacttcgtattcgaccaggggtggacaagaacgagagacacggcgcttgttcaatatcatctccagaaaaacggcacgggacgctttgaagtcacgccgatgaacattcatgaagcaacgcctgcaccggttaaaaaaggcagcatcaatcataaaacgatcgtacgtgaactgacgaaagaatcgaatttcaagtggagcgtcaaggatggaaaattaacgtttgatgtggatcacagcgatatcttaaaaaagaaagcggagtgaaaaacaaatgaaaatcattaaagcgggatggccgtttgccgcgatcattatggtatttatgtttatgtctgcgtttaaatacaatgatcagctcacagatcaggaaaaacaaaaaattgacacggaaatgcaaaaaattcagcaagaggacacagcgggcgcaaaataagcgcatgattccgcttgccggcatattgtttgttccgaatccagtaaagaatgcccatatcgggcattctttttttgtgtgctctcctaaacatttgttaaaagttaccgatgtaaaaactactaaaaatgaggagagtgaatagaaaacatgctcacaagctggaggaagtacatccttgccggccttatgatttgtcttgtggcacctgcagtaacgagaacggaaattgccgaagcggattctcaagtttctgtcctgatcgtttcagacgcgcaaaaacttgtcggaaataaatatgtttacggaggcgaagagcctgaggacggttttgacccgtccggattgatgcattatcttttcagcaggcagaacatccatctgccgagaacggtcagtgatcaatggaaagtcggagccgccgtcaaagaaaatgaccttttaccgggagatcttgtgtttttcaaaaagtcagattcaacacaaaacgcggccgtccatgacggtctgtatatcggaaacggagagatgatacacagttctccgtcagaaggcgtaaccgtcacacgctttcaaaaaagcagttattggatgaatttatatcttggcgcaaagcggatgacaaaagatccggaactggctgatgatccgatcgttcaggaggcagcccgttacctcgacattccgtatgtattcggcggaagcacgcctgaggcgggattcgactgttcggggctggtccaatatgtttttgaaaacaagcttcacatttacctgccgagatctgcggaacagcagtggctggtcggtgagaaaatcaaactgagcgacataaagcccggggacgtgatttatttcagcgatacgtataaaaaaggaatttcccatgcgggcatttatgcgggagagggaaggttcatccaagcaagccgctccgaaaaagtcaccatttcttacttggcggaagattattggaaaaaacatttcacaggggtgcgccgattcagcaatttagccatttctaaagacaatcccgttgtgtccacagcggccgatcatatcggaatttcttatctgaaaggcggcgcttcaccggaaaccggctttgatacggcgggatttgttcaatacatctatcaaaaagcgaaaggaatcagcctgccgcgttatgccgacaagcagatgcaggcgggcgttccggtcgataaacaagatctgaagcccggcgatctggtcttctttaaagcggaaagcctgaatccggccatttatatcgggaacggacaagtgattcatgtcaccgtgtccgcaggtgttaccataacaaatatgaacacaagcgcttattggaaggacaaatatgcgggcggcatccggcttccgtaaaaaaagacgtcagagagtgtctctgacgtctttttcttttaccgtttcggcgctctgtatccggccgctatcgcatcctctacagaacagaacatttccgcgggatctgtcgtccggtcgtagtacgtacttcccggcgtgtgataaatgccgtaccggctgcctttaatgtcgcatccctgtgaggtgccggctgctttcgtttcggcatgtcctccggaggaaggggcgttgttttgcgccgtttccgcgttttcggatgtttttgtttctgctttctgccgctttaaagttttattttctgactgaagcgtttcagcggtcttttcgagcttcttttgtgaattttttaatttctcattgtcttgtttgagtgatttgtttgtttttttcagctcgcttatctcttggctgagtttgctgagtttttcttcattgccggcttcagcttcggatttctccttttcggctgcggcactgatgctttcatattttttctcaagcgcctggtgttccttcgtcaatttttgataagccgtatcaagggtgctgtatttctcctctgccttcacggccgaggcgtccggctctgcgagggatgcaccggtcagaagcaggataaatccgccgatgagaagaggccaaaacagcttttttgaaaaatgtttttctttttttgccgctttgcatatgagatgaaaaattccgtatccgactgcgcagagaaaagctaaaaatcctataatagcgattgcattcgacatcatgaaactccttttttagaaaacatgaaaaagccaggccgtgaaagacctgacttttaccttttattgcccattgtcgagaagccggttgatgaaatatgcgacgccgttttcatcgttgctttttgtaatataggtgcttttttctttcagttcatcaatcgcattgcccatagcgatgcggtttcccgccgcttcaaacatggagaaatcattcgggctgtcgccgatggcgtaaatatcctgtttttcaattccgtacagtgaggcaagctccgtcagagcacgtccctttccggaaccggcagggaggatttcgataatgtgttttccggaagatgtctgggataatttccgatgatgtgtaatttcttctttggcgtttctcagtttttccatatcaaaagagaaacaaagaagcttgtaaacatgttcgtctccgttaaaaatcgcctgtatatcctgtacgggtttaatgccgaattgtttgaactgcgtctttgcgccctcccataatgtctgaatatcttccttaggattggcgcttttcagaatgtccagttctgcctgcagtttggactcgccgtcaaacggggacagcagatgatcatctgtatagacctcaaagtaaatgtctttgtccgttaaataagcggcgatatccttcccggcctgctgatccattaagagccggctgacgaggcggtatcctttgtcatggactgtcccgccgtttgccgcaatgatcggaatatccaaatccttcaagagcgcttttacatcaaacgtggctctgcccgtgcagatggccacgagaatgcccgcttcatccgctctttgtaaagccgctctgttttccggagaaatcacactgtccgaattcagtaatgtgccgtctaagtcaatggctatcaatttcatatgtatggatgccctccttaaaaataaagctgcttcatgtagtatgttcagctttgtgcgaaatcagcagaaagccgtcagttaaaaggctataccttcatgtcctttttttcaacagaaaaacggcgggatttgctaatcccgccgtgacatcttacgcgtctaaatcattttttaatttcgtttttacttcttgaaggttttcctcattcagcttgaagtaataaatatttttgccgtactgaggagtgtaaatgtagctgtctgaacctgtcagctgcaaagaattcaccgatttcagcgatgtgataaacgggaacagaccgatggcgtcattaagagataagttcatttttaagtttttccctaagctgtcgacgatatcgtcataagatgggatcgagcttaacgatttagattttttaataatggcgctcagcacttccatctgtctttgtccgcgcatcagatcggtgtccgctttgcgtgttcttacataagccagtgcctgctcaccgtcaagcgtctggacgcccggcttcagcacgacttttccttttgtatcgactttaatacgatcggcaattttctggcttttcacatttaccgtaacgccgttcaactcattgacgacatcgcggaacgcgtcgaagttgctttcaaccacataatctaccggaatatcaaacatgttttctactgttttataagttaaattataaccgccgtaagcatgtgcgtgcgcgaatttgtcatagccgtgtcccgggatgttgacataggaatcccgcggaatgctgagcatcgtcgctgttttctttttccggttgaaggtgacgagcacgttggcgtcacttcttgcgtcatctactgattcacccttattgtcacgggcgtctattcctaaaagcaatacggtgaaagaatccttcttcgggtcaaattctttgatccgttttacggactggtcgccgcggtcaaggctgacgtgcgcttctttggtcgcattattcaatttcacaaatgcgtaggtgccgacggaaccggcgatcaccaataagaaagcggcgaataccagtacaaatttcacccattttctgaggcgtcttttcttttttctgcgttgagatcgttcttccatatcattacctctcgtttctattctttgtgaagcgtaccataattgttgactcggagcaactctgcaaatgagaaaattctaaatctttctctctatttcgacaacatctactgttatttttgcatcaggttcacattatattggacggcaggaagcgggaaatgtttcgtcgctttgtgaaaaataatcagtaaaataatggatattaacggtgcggaaggtttgaaacgatcggaaacaggcaaaagaagcagtagaacaattccgcgcggatacagcgttggatgaagggagtctatataacatgaaaagcatacactcgaataaatggctctattttttcggcgctctcgggggcgcgttatacggatatgataccggagtcatttccggagctattttatttatgaaaaaagaactgggactgaacgcctttacagaaggcctcgtcgtcagttcgttattggcgggggcgattctcggatcgggattcgccggcaaactgaccgaccggttcggcaggcggaaggccatcatgggagcggcgctgctgttttgtataggcggattaggagtcgcttttgccccgaatacagaggtgatggttcttttccggattattctcggactggctgtcggaacatcgacaacgatcgtcccgctctatttatcggagctggctccgaagcataaacggggggcgctttcttcgctgaatcagctgatgattacggtcggaatcctcgtttcttatatcgtgaactatatatttgccgatgcaggcgcttggcgctggatgcttggacttgcggttgtgccgtcagtcattctgctgatcggaatcttatttatgccggaaagcccgcgctggctgtttacgatcggcaaagaagagaaagcaagagaaatcctttcatcattgcggggaacgaagaatattgatgatgagattgatcagatgaaagaagcggaaaaggaaaacgaaggcggcttgaaagaattgtttgagccgtgggtgagacccgcgctgattgccggcctcggacttgcctttttgcagcaattcatcgggacaaatacaattatttattacgcaccgaaaacatttaccagtgtcgggttcggcaattccgcgtctatattgggaacggtcggaatcggcgccgtcaatgtcatcatgacgcttgcggctattaaagtcattgataagatcggccggaagccgctgctgctggccggaaatgcgggaatggtcatcagtctgctcgtattggccgcggtcaatcttttctttgaacattcagcagccgcatcatggacaacggtgatttgtttaggcctgtttatcattgtgtttgcggtcagctgggggcctgccgtgtgggtcatgcttcctgaattattcccgctgcatgtccggggtatcgggacgggtgtctccactttgatgctgcatgccggaacattgattgtctcattaacctatccgatgctaatggaagcagtcggcatcagctatttatttctcatttatgccgctatcggaataatggcattcctgttcgtccggtttaaagtgaccgagacgaaggggaaaagccttgaagaaattgagcaggatctgaaaagccgtaacggaggctcgggatcagaatcaaatcggcggacagttcatccgtaatattcagttttaggggggcggttattcaccggcccctcaaaacggatgcgtgcgggcgcccgcacggtcacataaatgacggggatatgtcatacgttgtataaagtcacgataaaggcggggatgccggtgaaaacgagtattattatccttacatataatgaacttgagctgacgaaaaaatgtctggccagcattgaacgatacaccgacaaagataagattgaactgattatagttgacaacggttcctcagacggaacgagagaatacatatcaaatctgcctgacgtcaaagtcatccttaatgaaaaaaacctcgggttcgccaaggggtgcaaccagggaatcgaagcggcagggggagaaaatctgctgtttctgaacaacgatacgatggtcacgaaaaattggctcacctccatgctgagggtgctgtatcaatctgaaaaaaccggtatggtcgggcccgtcagcaactatgtcagcggcgcgcaaatgatccatgacgcgtatcaatcgcttgatgagctggagtcattcgcggaggcgtattgtgcacgggaaaagcatcaaacaaagcgggtgctgcgccttgtcggcttctgtcttctggtgaaaaaaagcgtcattgaagacatcggcccgtttgatgagcaattcggatacggttcttttgaagatgatgacctatgtctgcgcgccctgcaaaaaggatacagcctgcacatcgctctcgatgcctttgtgcatcaccacgggcatgcgacgtttacggctaatcaggatatcaatatcaatcagttatattcggagaaccgccagcgttttacggaaaaatggggcactgattttacgtactttactcatccgagaccggaaattgcggagctcgttccccgggaggcgaaacggatacttgatgtcggctgcggtgcgggagctacggggctggaacttcaaaacagacagccttgcgaactgtacggaatagaactgcacccgctggcggcgcaagcggcaaaaggacattatgaagcggtgctgcaggaagatgtcgaaaaagtgaagctgccttatccggaaggcttttttgattgcatcattttcgcggacatccttgagcacttaaaagacccgtggcgcgtcattgaaacgtactcatcctatttgtcgcctgccggatcaatcgtttgcagcattccgaatatttcccacgccgaagcgctgttcccgcttctgctcggggactggacatacagagacgccgggattctcgaccgcacccacttgcggttttttacgccgcagacggtgcgcacgctctttccggaagagacatttgacgtgaaaaagcagtcctatacgtatgttcacgtggatgagcgggtgcagctgtttttacaggaaatcacacgaatggcgcaatcgatgcaatttccggtgacacagctgcccgaacaaagccggatttatcagattctccttcgtgtcgaaaaaacacgctgaaggctaccgccccatcgttccgaagttggtaatctgaatggaaacatcatagtcaaaggccgcttcggagaaggtttcatcccagtgatgcttcactttcttccaatagtcgggatattgaatgcggactctgtcagaaaagaagacagggtccgtttcatattgattctgcagcttatcgatgacttctttcatatcgcttttcagttttttttcgaaaaccttttccagcccgtttaaatagtgctgatcgaatgaatcttctccggcatattgatcctctgacaaaagtccttttgttttcaccgctacgtgaaacgacagcttcccgtttttcagcagggggtgatggaggatgttgattttttgatctcgaaggtaattgggtgccctcctttatccaaagcgggcagcacgccgccctgtatcgtccccgtcagccaattcaggctttgtacttcgtatgatgacagaaagcctgccaatctgttttgttttccgtttttgataatggccgctccgtcatacaccgtttttcctttttgattgctgacggcctgaatgagaaaactgagtttattatggcagtaaatcgaagctctcccgattcggagcggttttaaaatcttcccgttgtagccgccgttgttcgtaaggtcgatcagcttttccgcgggcatgggctgctgctgattcggcgtcggctctgtcagaatatcggccgctttgcctcttgccgcgaagagatagctgctccgccttaattcatcatcacggataaaatggttcatcatctgcagtatattttggtcggccagcaatttgtcgctgaatatcagcacttttaaatgatcgctgtaaacgggcggatcttttaaagcgacttcactgacggcttcaagaatggtatcccccgcgacgtcacattgacaaacacgggccggccggaagcctggctgttttcactttggggcagcaggttttgataggttaatttatatcggcggtcactcgtctcgtctatcgccagcccccgggcgaaagatagcttttcgacttccttcgcatcccagcaccctgaaagcgtcatcagtatgaaaagcgccgccgcccattttacgaaatgtgtcatgacgtctgtttcctcccggctatttttttcatccagctgacaaaccagatgagaaaaggaatcataatgacggcaaaaaacgcatatccgagaatattcgcgaatgcaaacacactgttgatatcatcagggtacattgaaaggccgaatgtcactgccaataagccccccagcagccaggcattgtttttatttttcagtctgaaaatggtgtttaacccgagatgcgctcctttaaaagaaccgagcatacaggtgaactgctggcatgtccacgtaattaaaagaaagatatcaaacctttcgatgaaaataccgcggatttccaaggcgtgaatcagggaaatggtcggatatgtcaccgttttggcttcagcgatcgacatacagccgattacgacaagcagcgtaaagctgtaaaataagcctgcgcatgcgatgccgaagacggcagcctttttcgcctgcttcggatttttcataaacggcaccagataaagaatcacctcaagtcctgaaaaatacagaagggtacgcggaaacagctcaaaaaagcttttgtagcctccttccatgaccgggcggatgaaatccagtttaaacagtctcaggctgaatatgagcagcgtaatcagaatgacgatcgcaatcggaaagagataagcatagagttttgaaatgggatacaccccgccggtcacatggtagatgccgaccgccagaaagatgaatatgacgacacccatcggcgtatttttcagtaaaaagtaattgatgacctcaccgagaaaacgggcttgaaaacagacggtgacgacaaaataacagctgatgaataaattaagaagagaaccgatggcgcgtcccataatgctttgattcagctcataaatggtttccccgctgtttttctgcaaaaatggcataaagagcaggacgatgccgataaacacgagactctgcacaagaataatgatccatccgctcggactgtccgctgctgcggcggagcgcggcagtgttaacacgcccgctccgatcattgttccgcttaccatgagaagtgtctgcataaacgacagcttgtcttccggttttttcatggtgatcacctttgcttgattttatctttcgtctcttttctggtcggccgttttttcaaaagaggcgtcggcagtctgacgatcgtatcttttaagtcctgtcccggctgcgccatgatcggaataagatagtcctggccgaagcttttcaggcgcatcagatggccgacgacaagcagataacacatgatcagtccgtataaacctaatatcgccgacaaaatcatcgaaaaaatacggatgagtctcagcggaaaattgaacgcataggagggcgccgtaaaagaagccaatgccgtaacggatacgataatgaccatcatcgcgctgacgatgttcgcctgaacggcggcctgcccgatcaccacgcccccgatcaggccgatcgtctgtccgatcggcttcggcagcctgagtccggcttctctgatcatctcaatcgtaaaaatcataataaacgcttcaacaaaagggggaaacggaacattcaatctgcttccggcaatcgtcaccgccattctcgtcggcaaaagccccgtgtgaaacgtaacgagcgatatgtaaaggccgggtaaataaatcgtgattaaaatgcatgtataccgaagcagcctgagaaagttaaccggaacccaccgctgattataatcgtcaggtgagtggataaattcatcaatggtagccggcaccaaaagggtaaaaggcgttccgtctacaagaatggagacccttccttccaaaagagcgcccataacccggtcgggccgttcggtcgtcaagacggtcgggaaaatggaatacgtgttatcttcaataagctgctcgatcgttcctgattccggaatgtcatcaatggtgatcgaatccagtcttttcatcacttcttttacaacatcatcaggcgcaatatcccgaatgtaggcaacggcgatccgcttttttgtccgttcgccgagtgtgatctctttgatctggaggttgggatcaccggactgctcgcgcaaaagcgccgtattcgttcggagcttttcgacaaaacctatcctaggtccccgttcaagcacttctgaagccggttcttcaatatcacgcattttaaatgtttccgtttcaaacgaaagggcttcctcccatccctccgccagcaaaaccgatttgccggaaaaaatgtctgcctccgcgtccttaagtgaagaaagccgggtgtgacgatagccgaaagagatggatgacggcggtatttcagccggttcctcttgatgcagggcggccgcctgcacgggcgaaataatatattccgcaagcaattgattgtcggtcagtccgtctatatatataaggcaggcgtcacatttgccgtttccgtacgtaaacgaataaaacatcatgtcatcgctttggccgatccgttttttcagcgcttcaaggtttttgccgagctccgcatgtatcgtcataatgttcccccctttccatcagttattttaatttgcgacaaacaaggcattttattctggaataggaaatgactgagcattccgccccatccgaatggtataatgagcaggtcagccattttatacatattgtttttaaccgcggctccctccgtgttttaaaaaagacacagggggaatgggatatgagccgctttttaaggggaggggaacgaacatgacgcaagagccgatttttctacagcctgtatgtaaagaaaaaatatggggcggcacgttattacgcgaacgattcggatatgacataccttcagaaacaaccggcgaatgctgggcgatatcagcccatccgcacggaatgagcacggtcaaaagcggtccgtatcaagggaaaaccttgatggacctgtgggatcagcatagagagttattcggcggaacggaaggggaccggtttccgctgctgactaaaatactggacgccaaacatcatctgtccgttaaagtccatcctgacgattatgacgccgaggagcatggacagggcgaaacggggaaatctgagtgctggtacattattgactgtaaagaaaatgcggaaatcatatatggtcatacggcccgttcgaaagcggaacttgtcaccatgattaacagcggtgactgggaaggcctgctgcgccgcgtgaagatcaaacccggcgatttttattatgtgccgagcggaaccatccatgccatttgcgccggagcgctcgtgctggaaatacagcagaattcagacgccgcctaccggatatatgattacgggcgtacagatcaaaacggcggtgcgcgtgagctgcatatccgcgatgccgtcaacgccgccaccgttcctcatgtggacggatttttggatgaatcaactgaaacgagaaaaggcatcaccattaaaacctttgtgcagggagaatatttttctgtatacaaatgggatatcagcgggacggcggaaatgacccaggacgctccgtttatgttatgcagcgtcacagaaggaagcggctccatcatctttgaaggcaagtccgccaagcttgaaaaaggcgcgcatttcatactgccggatcagatgcctgactttacgataaacggagattgcacgatcatcgtttctcatatataaaaccaaacttaatcccagctctgggattaagttttttttatttggataattggatgatttctctctgtaaaaatgaagaaagcgggccgataaataaactagtttgatagaaaccaattgaatcagaaagaggagaaggaatgaaaaagagattcgttgcacctatgttattgtccgccgttttccttgtctttagcaccgttacacagcacgccgaggccgcatacagcgactactccgtttacgagctggaaacgaagcagcaatttgcttctgagaacgaggcgcttcaagcggcagcgaaattgaaaaaggatacggggtggcaggctgacgcaaagaaagccggaaatgcgccgctcacttatcaaatctcagcttcaggcttacacgatgaaacggatgcgaaaaccgtgctgaaagattttacgaagcagacgggcgtggccggcacttacagcgcaagcggaagcaaacagccgtacgtgaccgtcacatcaggcgttctatcagacgagcggcagacgaaaaatcttcttgccgaactgacgaaaaaaacgggcgtgaccggcgccgtcaagccggcggggacaaaacagccgtataagcaggtcgtgacttctgagatggcggccgatgcggatgcaaaagcgctctcgcaagcgttgacgaagcagacgggcgtgaaagcgtcataccgtcagatcaaacgggaaacagcccggtttcagatccaatcgggaacaatctccggcgatcaaaaagccgctcaaattcaaactgattttcaaaaggaaacaggattgcagtcgtcgctgaaagtcacggcaaaggccagtccgaatatcaccgtgacagcctctgacattttaaatgcaaataatgcggcaggtttagcgaaacagctgcagcagaaaacaggcgtcaaagggaacgttcaaaagtatgcccaaagcaaaacagcaaccgtgtataacgtgcagtcaggatattttaacggagtaagcgccgtacaaaatgctatcacccaaatcaagaagaatacgggtgtcagcggaagctatcaaaaagccggcaagaagaataattacacggtcgcgatgagcggactgacggctaaacagctgcaaagcgtgcaagctttctttaaaaagaaaaaatggcattgcgacgcatcgcctgtcaaaaagacagcatcagtgtccgtttaccggatcacggcagggcagcttaccgctgcaaaggcggatcaaacggaggcgtttttccgccagcagcatgtaaagacggcaagaacagcggcgggaaaaacagcagaaaacgaatatcagctgctttctcagcagacggcagaccagtcgaagataaaaaaaggattgaatctgctggcgggatataaactgactgccatttcaaaaacgatatccaagcagacggacacaacgtaccaagtcacaaccgaatcactgcttgatacggcaaagatcaatcaatcgctggattttttcaaagggaaaaaagtatccgcctccgcacagaaaacaggtgaagcggcgtatacacaattcagaattgaaacggcaccgctgcttaagaaggaagacattgaccgcgtgactgcttttttcaagcaaaacaaagcggccggcactgtgaaggagacggggaaaaccggctctgcacaatacgtcatcaaaaccgaaaaattcagcagtaaaaccgttttaaataaaagcatgagctttttcagcgccaaacaattacaggccggctatacgagtgaaagccatccggtttatgaactccgcattcgcaatcaattcacgggagcgcagtcagcggacgccgcctcccaaaagctgaaaaagctgtacggatggacgatggctattctgaaaataaaaaacggaccgcaaatcatgaacaccaattacaacatctcgctggcagatatggtcaaaaaacaaatgacagtcagcccgcagactgatgccgcggcttatgcatcgcttacgtacatcaatacggcctccggaacggtcacagccgacgtcctgaacgtccggtcaaccccggaagtcagctcaggcaatattatcgggcagttgaaaaaaggcgataaagtcagcatcacaggccagacaaacggctgggccaaactcagcatgggctggagaaacgccagcagtgacgaagtcgggcagtacgtcaatccggctcacttcgcacaagacagcaagtattactttcaatttctgaagctctctcagacagccggactgaacgcatcggaactgaatcaaaaagtgctggtcaataaaggaatactgacagggaaaggccaggcctttattacagccgccggcaaatacagcattaatgaagtgtatttgatttcgcatgctttgcttgaaacgggcaatggcacgtcagagcttgcgaacggcattatgtataatggtaaaaaggtttacaacatgtacggcatcggggcttatgacagcaacccgaattactacggcgcacaatacgcgtataagcaaggctggtttactccggaagccgcgattatcggcggagcccaatttatcggtgcgtcttatattcacaatccttcatacgagcaggatacgctgtataaaatgagatggtctccagccgcggctcatcagtatgcgacagacatcggctgggcgtataagcaggtaaaccgcatgtacagcttatactcactgctggatgactatacgctttactatgatgttcccgtgtatatgaaagtataaaaaaagggctgaagtgtatgcttcagccctttcttcatgcaaaaaacacccgcctcagattcaggcaggtgcttcagcacaatttttcatttttgtttccgcaaatttcaataacgcttcactcgaattcccatctgaatacatattccatttgtccgagaaccgcttcatttcttctgcatcaaatggctttttcgtcatttcctccaaaagagcttcactgtcatgacaagcctttccgggaatgacggaagtataattgtcgattaaaccgcgttttcgatcatattcctccagatcatacgtgaaaaagaaaatcggtttatttaagagcgcgaattcaaaaggcacggaagagtaatccgtaattaaaatatcagccgctttcaagagatcatgaagacgcatgtcagacacgttcttgatcaattcgctttcaaacgaagccgaaatatgatgcaaaacggcaggatgaagctttacaagcagcatatactctccgtttaacgcgtttgtgagctgttcttcggtgaatggcagccgaaaggactgcatatcataatccctgaatgtcggtgcgtacaggatgatttttttcggccatttgtgcttcggttcgggcttgtgttcttcataatagacgtcagtcagggggacacccgtttttaacagctggccgtcccgtatgccgaacgactttttaaaaacgtcagccatcgcgtctgaaccgacggtgacaaagtcaaacgagcggtacacttttttaaaacggctgatgtctgatgccggacggttttgattcgtcacatcctcaaggccgaactttttcaaagagccgttcgcatgccacacttgaatacatgtcgtttgcggccggcggtttaagacgcttgtcatgaggaaatagttatccgttatcaccgctttgctcttaaaaaggatcaaaaccgccttcaaaagatgcagcggatgtttttcgttcagataaaaagagccgagtccttccagctcttttttcagactgacggcgtgtctcgtatacaaaaccgtcacttcataagaaagcgattcagcgtgcgctttgtaagaacggatgagagcctgtgcattctcttcaaaagataccagcagggtcagatggttcttgggctttacaggcttgaacaaaacgcccagaacagacagatatatagaataaaaagcggcgaataaagatcgcaagttcatagattaccaatctcttttgctgttttatttgtttaaagctgtttcgtttgatcttctgcctgctcggaatacaggcttttatttgatttattatttctcaaaacggtaaaagcatacttcggaatgttcagcatccttttccatctccacggattcgtcaccagtctgtacagccattccagattcgttttgatcatccattcaggggcgcgtttcaccgttccgctgaacacatcaaagcttccgcccaaaccgatcgatacagcctgagggaaaagatgtttgtattcataaataaattgttcctgatggggatatcctaaggcgacaaacacgagatcgggtttcgcccgggaaatctgtttggcgacgaagcgtttatccgcttcataaccgttgctggctccgacaacctcaatattcggatactctttgccgatccggttcaaaacggcgtcaagcacgtcttgcttagctccgtataaaaatatttttttagactgccggtttgcgagaccgagcagcgacagaaatacatcgaatcccgcaattcttgatttcagcgggtgctgcgtcaaacgtgacattaacacgacgccgataccatccggcaggacgaaatccgcggaagaaatgacttgatgataacctttgtctttcgccgcagcgtatccgatctcagggttgaccgtcgcaatgacggctccttgcttttgtgcgatataataagtgtctaaatatgaaataaactcctgtaaatttccattaacataagaaaggttgtgcaccatttcagtctgcatctgccgtcctcctttttgtacgggattttctttcattttttcgtgacttaagctaagctttattttaacataataccttcagataaacttaacaatagttttacaaaaatataaataagataacaatttctttaatcaaccgcgcaaaaaccctgctaaactcctattgcaataacatttgttaataagtggaatttaacttcgttttacattagcttaaccttttcagggctatgtgatataatgaggttccatgagtacgaaattggcactttagtgattaaggatacagctgcgcagcatttcagggcagttgcttgttatacgtatgatgatagaaaggagcttttgtttcatgaagaaggtcattacttacggaacgtttgatttactgcattggggtcatattaaactgcttgagcgcgcaaagcagcttggagattacctagttgttgccatctcaacagacgagttcaacctgcaaaaacaaaaaaaggcctaccacagctatgaacacagaaagctgattctggaaacgatccgttatgtcgacgaagtcattccggaaaacagctgggatcaaaaagtacgtgacgtagcggatcacaacatcgacgtgttcgtaatgggagacgattgggaaggcaaattcgatttccttaaagatcaatgcgaagtcatctatctccctagaaccgaaggcatttccaccacacagattaaaaaagaaattgccggggtgtaattgaaacattcggatatacagatgataaagaagtactccctccggatagggagtacttcttgtaatataaggttattttcgctatatttgttatgcgcttttgaaaaaaagctagacaataagaggagaatttaaagatgaatcttagtaacttttttaagttgaataaaaaagagtccaagccgtccatagaagaacgcgaatataccattttaaacaaagaagcattggcggaagagaagaaggtagcggtagtcgttcctgtttataatgcagaagaatatgtaaggaaaacagttgattctgtgatccttcaaaacatcggctttcagcatatttctttaattctggtagatgattgctctaccgatgattccagaaacatcctgactgagtacgccgaattgtatgaaaatattacagttgtctttttgaaagacaacacgggaactccggcttatccgagaaacttgggaattgagctggcaaatgcgaagtacattacatttttggatgcggatgattggtttgcgccgaacggggttaaaatcttattcgacatgcttgaaagagatcatgtaaattatgcggtcggaaaaacgatcgaaatgcaggtgaacggtcaaaaaacgatcgggaaacatgagtcttcgctgaacagagcgaaggtatcgcctttttcaatccggcatattttctatcatctgggcccgcgggcaagaatgatgaacttacaatttctaaaagataacgatatcagatatccggaaatgaaatttgctgaagataagcaattttttatggatgttcttttggcgtgcggagatatttcaacgtcaaccgaaccggtctattatctgaacagaatggacaataatgagtcgctgacaaagcagaccaatataatggaaaaaaccgacacgaacatagccgtaatgaagtatattctgaacaaaaaattagatactgaaaaagagaagatggcgatgaaccgcctgattgaattcgattccattacgcggcttttcgatcggatgcacttcctgaaaagcgaaaacaaagaagcctactacaataaattcaatgaaattctgaatgtgttaaagaagacgaaatacgatatttccgagacattttttcatccgattcataaaacagcctaccgtctgctgactcaaaaacggtatgatgaggtcgaaaagctgttccgctggtccaaaaaagagcccgataaaaacatcgtgacgaaagacggactggcttatttagaaagcccgctgacggatgaagaaaataaactggtcgaacttcgcatgcacggagaaacggaaagcgcggtgttcgccgatcataaattcaccgttacgttccgcttgttcggacaggacagaaataatgcccaatatattcagtttcagcacagagataacatgaaagtacaccaccagtttccggttcagtcactgggagacgggcggtacgtccttgaaatcccgttaagtgacattgaaaaagtcggacttggcggttatattatgtatgtcatttataacgattatgaacgtgtcatgttaaacagagaagacggtgaaaaggtgacggcagaagcgaacggactgcaatatcaattctaccggacggtgaaggagaacctttcactgaaagtaacaaaatgatgattgtgattggatatgtttaattgaaacagaggagtagacttattttatgggtatagaaaatcctgtcagatacaagttaaaacatcttaacataaaggaagagacattcagcattacgatatcctgtgaaaatgtcactgcaggggaagagccttctcttcagattataaatcgtaaaacaaaagcggaactttccgtccctctgaaacggttggccggagagggcggagagtaccatgctgtcatgagcacggatctgctttctgaccatacggacggcaaaggatgtctggatttctatgtctcctttatcaatgatgacagtgatatcagtaaaaaacggttaaaatccagccttgaacctattgaactgtcttcttataaagatgaggctcatcatatgtactttttcccttacacgacgaagaaagggaatttctccttaaagctgctgcagaaaaagttcgtcacgcggattgatgaaatggagctcgaatctgacggcagcttacatctgaaaggttttgcattccggctgaatgcggcagaaaccttaaagataaaagaaaaaaacctgattctgaaaatgaaaaaaggaaaagaagaggagcctctcattctgaagtatccgcttcacgacgtgccgagacacgaccttgatgaatatgttcaggacacaacgatgcttgacacgataggctttgatacaaaaattgatttgaatgctgtttataaagaattgaatcagcagctcatctttcaattccatattcaattcatttttgaagatgccgggacaggtgaagaggttatcaccaacagcaaaccgttaaaggttctgaaatctgaacatgtaaaccctaaccaattcacggttctgaaaacggaaaaagggcctgccagatttcacgttttcacgaaaaagaaaacgaaaaatctccacctgagaatgaacgattacagcttcagcacccgcgtggagtattttgtgaaaggtaagctgaaacggggcgcttcctttgtacgcaagagaaagaataagctgaaaaagttcattgagaaaagaatacagaacacttacaaagcaggattcagatttgcaggaaaactgcctgtcaaacagaaacttgtcatgtttgaaagctttgccggaaaacagtacagctgcaacccgcgggcgatttatgaatacatgagcaaagagatgccggaataccgtctctgctggagtgtaaaccccgcttactcacagacatttaaagataaagggattccttatatcgaacgcttcacgttcaaatggctgtttgccatggcaagagccgagtactgggttgtcaacagccgtatgccgctgtggattccgaaacctgagcatacgacatatgtccagacatggcacggcacgcctttaaagcgccttgccgtagatatggatgaagtgcatatgcccggaacaaacactgaaaaatacaagcgcaactttacgacagaggcttcaaagtgggattacctgatttcaccgaacgcatattcaaccgaaatattcgcccgggcgtttcagtttaataaaaccatgattgaatcgggatatccgcggaatgacttccttcagacggataacagcccttctgtcattaaagcgctgaaagaaaaaatgaatcttccgcaagataaaaaagtgattatctacgcaccgacatggcgggatgaccaattttataagaagggaaaatacaagtttgaccttgatttagaccttcaccaattgagagaagcgatcggcgaccgttatgtcattattttacggatgcattatctcgtggcggaaaactttgatctcggaccgtatgaaggatttgcgtatgatttctccagctacgaagatatccgtgagctgtatatggtctctgatttactcataacggactattcctctgtcttttttgactatgcgaatctgaaaagaccgatgctgttttatgtgcctgatatcgaaacgtaccgggataaactcagagggttttactttgactttgaaaaagaagcgcccggcccgcttgtcaaagaaacaggtgacgttatcaaatgggtcaatgaaacggaatcagatgattataagcttccggattcgttcgggcctttttacgagaagttctgttatttagaaaccggagaatcgtctgaaaaagccgtaaaagtgattttcggggacaagtaaataagtgcaaaaaagcataatttaaccatgttaattatgcttttttgcttaagtgacggcatgttgcgctcatgggactcaggcttgttatgaagtgaaaaatacatcgtaatctgttacaattatgagcggtgcttttgtaagtcaaagctattacctaaaacttacgactaaggaagattagaatgaatgcattggtaaaaattctgaaagagcaattcaactcatttccgctgattatgcggcttgcagtgtacgaaacgaaatcaaagtatcaagtgaactatttgggtatattgtggcagtttctcaaccctatgattcaaatgctggcttactggttcgtatttggcctcgggattcgcggcggacatgatatggtgcttggaaatggagacagcgtaccgttcatcgtctggatgctggccggcttaattccttggttctttatcagtccgacgatactggatgcatctaacagcgtttttaaacggataaatttagtgtcgaaaatgaactttccgatcagttcactgccttctgtagtgatagcatcgaatttattcagttactttgtgatgatggcgatttatattattgtgctgctgagcaacggactgtttccgacgcttcactggctgcaatatatttattacttgttttgcatgatcagttttatgtttgctttcggcctgtttaattcaaccatcagcgtattaatcagggactatcagtttttgcttcaagccgtcacaaggcttctcttttttcttctgccgattttctgggacattgcggagaaatttggaaacagacctgaagttttgaccatcttgaagttaaaccctcttttctatattatcgagggcttcagagacagctttatggaagggcagtggtttttccacgatgtgaaatacacgctgtatttctggttcgtcacactgctgctgttaacagtcggttcacttcttcatatgaaattcagagataagtttgttgactttctttaatatagtaaggagattatacgatgaaactaaaagtttcgttcagaaatgtttcaaaacagtattttctatataaaaaacagtctgacaaaattaaaggattgtttttcccaaacagaaatcaaaaaggttttttcgctgtccgaaatgtttcttttgacgtctatgaaggggaaacgatcggattcgtaggtatcaacggctcgggaaaatcaacgatgtccaatctgcttgcaaagatcattccgccgacaagcggtgagattgatatgaacgggcagccgtctttaatcgcgatttctgccggattaaacaatcaattaagcggcaaggacaacatccgtttaaagtgcttgatgatgggtctcaacaatcggcagatagacgagctttatgaaaaaatcgttgaattcgcggatatcggcgactttatagatcagcctgttaaaagctattcaagcggtatgaaatcccgtctcggttttgccatatcggcgcatatggaccctgacatccttattattgatgaggcgctctcagtaggggaccagactttctatcagaaatgtgtggaccgcattacggaatttaaagaacgcggcaaaacgatctttttcgtcagtcattccatcggacagattgagaaaatgtgtgaccgggtggcttggatgcattacggcgaaatgcgtatgttcgacgaaacgaaagccgttgtaaaagaatataaagcttttgtggattggttcaacaagctttcaaagaaagaaaaaaagaaatatcaaaacgagcagattgaaggcagaacgcgggcagccgaggaacagaaaatcactcaggcccagcaaaagaaagcgaagcctaaattcattgccaatacgatacagattacgctgcttgcattgctggctgtcggcgcaggcgcttcgatgttttcagacaagcctctgcgtgcgatcacatctttcggtgacgtcaaacagagcgatgccggcctttatgagtctgtgaataaacctgctttggtaaaagctgaaaaggcggacctttacactgaaaaagatataaaaggaaaagcctccgcaagtgtaagtttcggtacgaaggtgcagatagaagccgagaataaccaggcggctaaagtgaaattaaacgataaagagtactttatgaaaaagactgatctatataaagtgaacgctttaaaaaagacggatgttcagctgaatgatttcagcggcagtttatcaagccaaacagcagaagagtttctctcatatctcaataaaagccgggacgatgtgcagcgtaaattgaaaaatccagctgcgggacaaacggctgacggacggaacgtattaaaagcatccgatgcaaaaacggatgtagtgattgacaatgatacagtctccgaagtggtttttcatttatcgcgtcctgcagacatctcagctttaagtgaaaaaggcggcagcaaaatcaatcagaatttgctcatgcttaaaaaccaggaatatactttttctgtgaacaatgctgataagacactgacggtaacgtctaaaaagtaaagatcacataaaaaaagctgccggattcggcagctttttctattcgtcagcttcttctttttcaagaagatccttcatgaacggaattaatttatggcggatatcctgatcctgtaaggcaaattcaagcgtcgtctcgataaatcctagtttttcaccgacatcgtaacgttttccttcgaaatcataagcgaagacacgctgaatgtcattgagcttttggatggcgtccgttaattgaatttctccccctgcaccgacttcctgctgttcaaggtacatgaaaatttcaggagtgaaaacgtatcttcctaaaatagccaagttggaaggagctgtgcccggttcaggcttctctacaaaatttttgacctggtaacggcggccttcatttgttaacggatcgataattccgtagcggtgtgtgtcgctttcaggaacttgctgaacaccgatgatggaagacaatgttttttcgtattcatccatcagctgacgaagtcccggtttttcagcctggacaatatcatcgccgagaagaacggcgaaaggttcatcgccgatgaagttgcgtgcgcaccaaacggcatgaccgagtccttttggctctttttggcgaatatagtggatatccgcaatatttgacgattttttcactttttgaagcagttcgattttccctttttcttctaaattgcgttccagttcaggggcattgtcgaaatggtcttctattgctctttttccttttccggttacgataataatatcttcgatgccggattcgacagcttcttcgataatatactgaattgtcggcttatcaacgattggaagcatttctttaggcattgcttttgtggccggcaaaaaacgagtgcctaaacctgctgccggaataatggctttgcgtactttcttcactgaataacaccatccttgtttctgcaaaatctttttttcagaactataacctagtctttttccactttaccacaattgattaaaattcacaccttttaatccgctttcaaagagtcttgtaacggtttttgctttgtttgccattaagctttacaatattaagaaacggcataaatatgttaacatgaagggatatccgacatataaaacgaggtgcagacaaaccgttgaaaaaactaaaagtaatgaccgtattcggtacaagacctgaagcaattaaaatggctccgctcgtattagagcttgaaaaatatcaggaaattgattcgctggtgactgtaaccgcacagcacagacagatgctggatcaagtgcttgaagcattcagcatcacgcctgattttgatttgaatattatgaaagagcgtcaaacgctttcagaaattacatctcatgctttgctgaaactggacaagctgtttcaagaagtaaaaccagatatcgttttggtccacggagatacgacgacaacgttcgccggaagccttgccgccttttatcatcaaatcgccgtcggccatgtggaagccggtctgcgtacgcaaaataaatactctcctttccctgaagaaatcaaccggcagatgacgggcgtgatcgctgatgtgaattttgcgccgacaagccaggcagaacagaatctgcttgctgaaaataaaaagccggattctatatttatcacgggaaatacggcgatagacgcgcttcaaacgacagtgcgggaagactattctcatccgatttttgacaagctggaaggaagcaggatgattcttttgacagcgcacagacgtgaaaatttaggcaggccgatggaacagatgtttaaggccgtcagaagaatcgttgaagagtttgaggacgtacaagtcgtttatcccgttcatttgaatcccgcagttcgtgaggccgcagaagcccattttgctgattcggacagggtgcatttaatagaacctctggaggtcgtggatttccataacttcgctgcgaaagcaaatttcattttgaccgactcaggcggggttcaggaggaagcgccttctctcggaaagccggtcttggtgcttcgggacacaaccgagcgccccgaaggagtgaaagccgggacattgaagctggcgggtacagatgaagaaacggtgtatcagctgacaaaacagctcttaaccgatcaggccgagtatgaacggatgtcaaaggcgtcaaacccttatggtgacggatcggcctcaaaacggattgcggaagaactgctttatcggtacggctatagaaaaacccgtccgcagccttttacagaataaaaaaactctgcatcatatgcagagttttttattatttcaggctttcttttaattcttttttgactgaagcgaggcttgcttcatctaatttgtaataatagatattgttgattctcgttcccgttcccttcagttcatgctgagtgactttgctgcgggcatttttatagtcagtcataaccgtccacatatcatcgaatgacatgtttgttttcatattgttttcaatgaccttaaacatatctccgaatttcgtgacagacgagatgtttgcccccttagaaataatcccttcaatcacttggcgctgccgctgctgtctgccgaaatcccctcgggggtcttcttttctcatgcgggtgtaggcaagtgcttcttcgccgttcaggctgatgttccccgttccgaaagaatgcccgtcgtagttgaaggcgaacgtgctgttcaccgtaatcccgccgagtgtatccacggtatctttgaagctctccatgtttactttcacaaaataatctaccggcacgtcgagcaggtcctcgacggtatccgcggccatttgggttccgccgaaggcataggagtggttgattttatccatcgtacctttgccggagattttcgtatacgtatcgcgcgggatgctgaccatttccgttgtattcgttttaggattgacggtcatataaatcatcgtgtccgcgcgccctttgtcatttttccgctcatcgactcccatgattaaaacagaaatcggatccttctttccgagatctatatccgtgtcacgtttgtccgatttttttaagtcttcctgaatgcttgccaccgttgaagccgctttgtgccacaagtagtagacgtagcctcctgatgataaaactaacagcccgatgattgttacgattgtcagaagaacctttttcttctttctttttcgttcagctctcatttgtcatcaccttttctattaactttcatgatgcaatttactaatctttataaacccagtcatatttttacttataaccatgtaatagacgaaattcttaaaaaaaaggttacaaaaagaccttaaaattaccttaaaaaaaagttagtataagacgatacataaagatgaggtgaaaaaaatgaaaaaaactattgcagcttcgttcttaatactgcttttttctgttgtattggcagcgtgcggaacggcggaacaatcaaagaagggaagcggttcttcggagaaccaggctcaaaaagaaacggcatattatatcggtatggcggatacgcacacaattgaagtaaaagtggatgatcagcccgtcagctttgaattttctgatgacttctctgatgttctgaataaattcagcgaaaatgacaaagtcagcattacttatttcacaaatgataaaggccaaaaagagatcaaggaaatcgagaaagcaaaataatacaccatgatcagcaaaaggcgggataaaaattgaagaaaacaatatgggctgtctgtttttctgtgatattcagcctggctttattaccggaaagcacttttgcggccagttctgatatctcagtaaaactgacgaattatattggtaataaatcgactctgaatatcgaaccttcaggaacttataaactgacgggaagcgatgtgtcctccgttgtcagattgggaggcgcgtccaaatatgatacggctaacgccgcgacatctaagtattggaaaaacccgtccaacgtagtcgtcgtgaatacggacgcttattttgcggacacgctttccgtcattcctttagcgaataaactgaaagcgcctgttctgctgactgaagcgaaaaaactgagcagcagcacagaagcgcaaatcaagaaattcaatccggataatattttaatcatcggcgggacgaacagtatttcgtcagccgcggaaaagacattgaagaaatacggccgtacgaaacggatcagcggaaaaaacagatatgatctgtccaaaaatattgcggccgaaatgggcagctatgaccaggcggtcgtagtaacggggatgtatatacggatgcgctggcaatcgcgccatatgccgcgcaaaacggctatccgattcttctgacgaaaaaagactcccttccgagctacaatctgcctaaaaaagtgatcatcatgggaggcacttcaagcgtcagcaaagatgtggagaatcaaattaaaaagaaggcctcggtcaccaaacgaattaccggatcaaacagatatcaaatatcagcaaacgcagtcacttcgcttggcatggatgcaagcaaaacggtggctgccaacgggactaaattagcggacatcgtagtcggatcaaatattgccgccgcaaatcacatgccgcttgtatacatcaaaaaaagcgaaacacccgccgacgaggccggcctttttaaaacgaaaggcacctattcttatacattaataggcagcgcgaattcaattgccgattcagttaaggctgcttacgcaaaagagttttatctcgtaaacggaaagacgtaccgtattgaaacgtccggcggcaaattaggcgttgcaggcattaacagcggaaaaacgtctttcaaggcggttcctgaaaaatattcaacagcaaacacaatcagcattgacgggaagccatatctggggaatatgagtttcactgctgaatccggcaaatatgtaagacctgttaatgaaaacattccttttgaggattatctgaaaggtgtcctgccgaatgaaatgccgggaagctggccgacagaagcgctgaaagcccaggctgttgccgcccgcacctactctatcggcaagatgggacaaacagtcgcggatacaacggcctttcaggtttacgggggatacagctggtatccaaacgccaccgcagccgttaacggaacaaaagggaaagtgctcacttattccggcagattgatagatgccacttactcatcaagcaatggcggttacatggaagccggcgatgaagtgtggggatcgaaagtgccgtatttagtagccaaaaaggacacaaaagatcccgaaatcagctggtctttaacattgcagaagcagcagctgccagcgggtctggatatgaaaaatcccgcatcctggtggtctaaaacaaacgaagcaaatgctgcgcagctcaacggaataaaaaattggctgatgaaaaataaagaaaccaatgcaagttccataaaaattgcaagtatctctgatctctcgctcaccggaaaaacaaaaggccagcgcgcggaagacgccgcggtgaaggtcacgtaccatgtgaatgacaagtcgaagggctatgtcatgaacaagactgcatctgttgaggtgaaagcgtctgaacttaggacgatgatcggagcttcatcttttaaaagcacatacgccagtgcgtccggtaattcttcgcaaatcacgatatcaggaaagggatacggtcacggcgtaggaatgagtcaatacggagcaaaagaaagagcggaggccggagagccgtatacttctattcttgcgttctattatcctaatacagcacttacaaactactaaacttctgtggaggagatcggattgaaattcatcataaaatgtctccccgtctttattctcggggtcattctatttgtcccttccgctttggctgacaacacggttaaaaggatcggcggaagcacccggtatgatacggctgtactggcggcaaaacaatcatggggtgaagcgaaaacggtaattatcaccggcggaacttcatatgccgatgcaattgccgctgcgccgcttgcatatcaaaaaaatgcgccgctgctgtttacaaataaagatcagctgtctgccggcacaaaaaagggattaattgatttaaaaacgaaaaatgtgattatcgtaggcggcacacctgccgtttcgaaaaataccgcaaatcaaattgctaaattaggcatcagtgtcaaacggttatcagggagcacgagatatgccacagccgcaaaagtggcgggtgaaatgacaagatcttctacagcccttgtggtcaacgggtttgttgatgcggatggaatggctgcgatttcttatgcgtccgctaaaaaatatccgattttattcactaatgattcaacgttaaatggttctgcgtccaatgcgatcaaaagcttagggattaaaaacacgattgtcatcggcgggacaagcagcatcagcagctcactttataataagctgccgaacccttcgagaatcagcggcaaaaaccgctataacctgtctgtgaatcttgcaaaaaagacaggcttaagcacaggctatacgtttgttaccaatggctttaaagaggcggataccatcgtcggaggcgtgctgagcgccaaacagggaagagttcacctgctgacgaatggagacagtctgtcaaaagacgtccggacgtatatcggaagtaaaaacatcaccagcttcaccgtcataggaagtgcttcatctttaagcaacaatgccgcgtcgcagcttaaaaatcccgttgtcggcaaaacggtctttattgatccgggacacggctatcaggattcaggtgcaaccggaaacggcttgcttgagaaaaatgtaaaccttgatatcgctacgcgtcttaacaatcaattatacggcgcgggcgcgcttactgtaatgtcaagaaagggcgacacctttgattcgcttgaggagagagtgaacaaaggggcgaaggcgaacgccgatattttcatcagcgtccatgcaaatgcgaatgataacagcagtgcaaacggtacggagacgtattatgataaaacctaccaatcggcaaacagtctgaggcttgcccaaaatattcagccgagaatggtttctgctctcggcacgcgtgaccgcagtgtgaaaactgccggattttacgtcattaagtattctaaaatgccgagtgtcttgttagaaaccggttttgtcacaagcccgattgatgccaatattctaaaacaatcaacgaaaaaggacagactcgcggcggggatcacccaaggcgtttcctcctatttcagataatttttttcatggaaacagaccggttcataccggtctgtttttttattttttcattatgctttgtctcaaatatggatatgaatagatttacaataaaaaaacaataatcgaaacattctaataaacattaacgtttcctttacttccaattaacatccatctgctaaactcacggcataggtcatcaaacatcccaacaaatcgtgaggtgtgtgtcagtgggagcagagaaaagcatgaatgtaaataataactatgcagtgcggcaggggacttccgctgccgttacggaaagaacggcccgttatttggcttttaagcgattcatggacattgtgtttgcgcttgcggggcttttggcggcgctcccggtgatgggcctgttctccatactgattcgtttggagtcgcccggcccggctttttacaagcaggagcgggtaggcaaagacgggaagccgttttatttgtataagctccgctctatgaaaatagatgctgaaaaatcgggggcggtctgggcgctgaaaaaggatccccgcgtgacaaaggtcggcgcttttatcagaaggacccgtattgatgagctgccgcagctggtaaatgtgcttcggggagaaatgagcctgatcggcccgcgtcccgagcgtcccgtgtttacggaacagtttcaggctgagattccggggtttacggagcggctggccgttaagccgggattaagcggctgggcgcaggtcaacggggatatgacatgacaccgagggaaaaactgatgtttgacttatattatatccgcaacctgaccttttcattggaactgaagattatgctcaaaacgtgcaaagtgatctggaccggtgacggggcgcgataaaaattctggtcagcagacaaaaaagtagggaaaacgatgcctagtattacaaatcaaattttgagcggcgccaaatggacaagtatttcgacagcgtgtattacggtcattcaaatcgtccaattcgccctgctcgggcgggtcatgtcactggctgaattcggccttgtcggcatgatcacaacggtagtggtgtttgcccaaattgcgcttgatatgggttttggcgccgcgctcattcaaaaagatcatgtgactgataaacagatgtcttccttgtactggctgaatatcataacggggcttgcgctgtttgcgctgctgttcttcagcagtccgctcattgccgatttttatcggcgggaggagcttgtctatttaatccgcgtgctggccgtcatgtttttaatcgcgccgatcggtcagcaatatcaatatatgctgcaaaaagcgctggcatttaacacgctaagcaagattgaaatcttttcaaatgtgctgtccttcgtttacttggcggctgcggttttttatacggacccgattctcgcctatgtgatttcccaggtgctgctgcaatcgtcaaaaggtattctgtactgggtgtcctgcagaaaaacatggagaccggtgttcgtttttgatctgaagggaatgaaaggcttcttttctttcggagcctttcagctgtcttcccggcttgtgaaccggctcggggcgaatattgatatgattctgatcggcagttttatcggcgccgaggcgctcggcatttacaatctggcctaccagattgtcacgcttccggtattaaaaatcaatccgatcattacgagagtcgcgtttcccgtctttgcgaaaaacaagcatgaaaacagcgtgatcagagaaggttttctcaatatgaccaaaatactcgcgctgatatcctttccgcttttgctcggtttggtttcagtatcggatgcattcgtggcttcggttttcggagaaaaatggctggcggctgtcccggttttaaacgttctcgccatcgtcgggattttaagggttctgatgaatccgaacggatctgtgctgctggcaaaagggcgggccgatctggcattttattgggacgccggggtgatgctgctgtatggtgcatctttgtacgccgccgtgctgtccggaaatctcttgacggtagcctggacgtacgctttcatcagcatcctgaatttcctgatcgggcgctggctgctggcatatgtcattaagctgcggctgtcggcttacttcaaagccgtggccaaaccgtttctgcttacggcggcaatgggtgtcatcgcctttacagccagcttcgggacggagcggatcagccttgatgtcaagctgcggctggcgatctccgtatcctgcggagcgttgtgttatttgttcctgttaggaaaagcttatccgcatatgaaaagtaaattaagaaaaggacgtttgctatgaaggtattgtggatgacaagtgtatatccgagcagtgagaagccgggagaaggcgtttttcatgagacgcaggcccaagaactgagaaagcttggcgcggagatgactgtcatttgtccccggccgaaactcgccgcgccattccgggtgctgaaaaagacgtatcggcaaaaggatataaggccggcgcatgaatggcggaaaggcgtgtccgtccaccggccgttttatcaggcggttcccgggcagctgaaatgggcgcagccgcataaaagaatggcgtcatcggttctttccgaaattaaaaatcatggcctgaagcccgatctgattcacgcgcatttcgccatgccgtcaggcggagcggccgccattgtgtcaaaggctttaggcatcccgtatgtgctgaccttgcatggcagtgatgtcaatgtctatccgcattacagcaaaagcgctcatcgcgcatttacatttgcggtgcgggaagcagccgatatttacgctgtgagcggcagtctgcgggaacaaatgaaaaagctcatcgaagcggagtgcagcgtgcttccgatcggcatcacgcttgacgccttccgaaaaaggaacgagacgaaagaagccgtcagaaaacggctcggccttcctccggataaaaaactgatcgtgttcatcggcaggcttgtcaaagagaaaggtgttttcgacttatcaaaagccgttcagtcattggatgaaagatatgaagctgtctttgtcggtgacggtccagccgcatcttcattgcgtgaagccgctcatatcgtcacggggcaagtgccgaacgacaaggtacaggactatctgctggcctcggatgtaatggcgctgccgtcctacagcgaaggcatgccgactgtggtcattgaggcgctcgctctgaaggtgccggtgatctgtaccgatgtcggaggattggcttctttatttgggaaatatagaggtttgctgatcaagccgggttcacctggcacgctggcagaatccattctgcaatatgacgaaggagaggcttggacgccgcaaacagccgaggaactttatcaaaccgtccgcacgtattttgacgcaagccaaaacgcgaaagcgctgaaagagaaataccggtccgtcatgaaccggtccgggcaagaggagaacctttcgaaagagggatgaagctgtgaaaaaaatcgctgtattaggaacagggtatgtaggtcttgtatctggaacttgttttgcggaaatcggccatcatgtgacttgctgtgacatcaatgaagcgaaaatcagaagcttgcaaaacggagtcatcccgatatatgaaccggggcttgaggaattagccgaaaaaaatgtcagtgacgggcggttatcctttacggccgatattgagccggctgtgaaagccgctgatatcatctatatcgccgtcggtacgccgatgtcaaagacgggtgaagccgatctgacctacattaaggcagcggcgcaaacaatcggagaacagctgaacggatacaaaatcattgtcaccaaaagcactgttccggtcgggacgggaaagctcgtttaccaaatcgtcagcgaagcgtcaaagggaacatatccgtttgatgtcgcgtcaaatcctgaattcctccgcgaaggttcggcggtgcgggatacgatgcagatggagcgggcggttatcggcgccacaagcgaacatgccgcttcggtcattgaagagcttcataagccgttccgtacgaagatcgtaaagaccaatcttgaaagcgcggaaatgattaagtatgccgcaaatgcttttttagccgccaaaatatcttttattaacgatatcgccaatatttgcgaacgtgtcggggcggacatttctcacgtgtcagaaggcgtcggtcttgacagccggatcgggaataaatttctgcaggcgggcatcggattcggcggatcctgctttccgaaggatacaatggctttattgcatatcgcaaacgccgccggctatccgtttgaaatgatggaagccgtcattgaaaccaatcagaagcaaagggtccgtattacggaaaaattgaaccgcgccatcggtcccttaaaagggaaaaccgtggccgtactggggctggcctttaaaccgcatacaaatgacgtccgctccgccccggctcttgatatcatcacaagtcttaaagagcagggcgctcacgtgaaagcgtatgatccgatcgcgattcccgaagcggcagcgatattaggagaaggcggcattgaatatcacgcagagatgtacagtgccatcaaaaacgcggacgcatgcctgattacaacagattggccggaagtcaaggagatggatcttcagagagtgaagcggctgctcaaacagccggtcatcattgacggcagaaatatgtttccgttggagtatatgagggtttcaggattcacttatcattccgtcggacgtccggcggttcatgccgatcggcaaataaaagaactggcaagatagaaaaagatttgtcttcaggctctcggcagcccggctcggctgccggttttggaaaggggtttgccatgtgagtatcaaacgttcagcggcacatgttcttgtgctgcttgccgctgtcattacaggaggattcatcatgctggaggcggtcagggcggatgccggcctcggaaaaatcaccgtgctgctgcttgccgccatgatcggtattgccggacttgctttgctatccgcctttacaacaaacggtcagatgtttatggggctcatttatatactgatcgcgtgtacatttttaaaccaggccttctttgcggttcatctcggatttttcagcttatttatataccggctgttattaatcggagcgggcgccctacacatcgccggcatcctgacaaaccgtcatcatattgacagatggaatcgggtgaatgtaaaaggggttctgatgtttttcgccttatggtttacatacggtctcctatcgttattgtgggcaaaatccgtgacgtacgggattaaatatttagctttaataggaatgggcatgtttttgatttatcttattgtcatgttcattcagcgctttgatcagctgatggttttttacggcatatggcttgtgatgaccatttttgtgatggcgatcggcttttacaaccattttacacacaaccatctgccgagctccacgctttataacggcccgcagtacaaacagcattatccgacgtccgttttctttaatcaaaatgatttcgcgacgtttttgtgcatcagtttctttctgtatgcggcggcggtgaaaaatatgaaaaacggctatgtgaaggccgtcagcctgctcttagcgatctgcgctttgtatttaatcattttgaccggttcgcgcgcgagtctgctgggcatatgcgcgggggcggctgtatacgtcttcatcctgctgccttctctgttgaaaaaattcgcgctgtacgctgcgggagcgggtgctgcgctgtttgcggttttatttgcgggccgtatcaccaatgccgtcttgaatctgttttcagctccgcaggcgatgccgggacagcagccgcttccttccaacctcgccagggcgaatcttttaaagaacgcctttcactatgtaattgattcctgggggtccggagtgggtgccggaaacgtctcttactatttaaaagcggagcccgtttatgatacgggcggcgtagttgaggtgcacaactggctcgtcgagattatggcgaacttcggcgtacttacgatgctcggttacctgacagtctatttgttccttttttggacactttataaatgtcatgaaagaaaatcggaaaatcagtcaagactgatcacagaaggacttatcacggcgatggccggttttttggtaagcagcatcagcccaagctccgtatcgaatttatttttccactgggtatttctctcgctcgtgatcgcggcggtcaatatattgaggcgtttacaaaaggagcctgccgtcacggcgtactatgaaaaacagggagatgcgagatgaaggatatgttgacaagaataacccggcgtatcaaaaagaatatcatttggatcattgcgctgcccgttgtgttaggggcggcgggatatgtattgccgtcaaaaatcagcggaaacagcagttttacatcagaagccgcgatcgccgcgggaaattatgatcatccgctttataacaatacaaaagaaatcccgctccttttgacgagcgatgcctttttaaagcaggctctgcctcataaaacagacgaagaaagagcggccgtgaaaagtaaactgactgtcgaaacacaatcagattcattgatcacggtcagctgcagcggccaaaacaaacaggaaaccgaatcggtgtttcaagccgtcataacaacttttctgaagaatgatcaggacctgtttgaaaaacgggcaaaagtagtgcggcagagtattgctgcgcttgaaggagaaaccgtcagcgcggacgccaaagtggataaggaacgatttttatacgaattgaaaaatacgcagctgaacctgaaagcggccggcgtcatcaattcagagccgatgaatgaaacggctggtcaaggcatgccgccgaaaaagaaagcggttctgggcgttttaatcggcattgcagttgcctttatgttcattgtcattcctgagttttttagagagtccttgtaaaaatctgcgatggagatgtgaccatgacaaactggaaacctttcgtatctgtcattacaccgtcttataacgcaagtgaatatatcgaagacacgattcagtccgttttacaccaaagccacccgcattgggaaatgattatcgcggatgattgttcaacggacggaacgagagatattttacggcaatatgaacaaaaagatgagcggatccgcgtcgtttatttagataaaaacgggggagccgcagctgccagaaatacagcccttaaacatgccaagggccgttatgtcgcatttctggacagcgatgacagatggaaaaaggaaaagcttcaaaaacagcttgcgtttatggcagagcggtcctgcgctttttcatttacgggctacagcgtcatggagcaggacggaacgccgacggacaaaacgattcaagcccctgaaagcctgtcatatgatgaagctttaaaaaacacgattatcggatgtttaacggtcatgattgacagagagcagacggggcagattcaaatgcctgatatcagaacgcggcaggatttagcgacatggctttccctgctgaaaaggggatttacggcttacggcctgaatgagtgcctttcagaatacaggcttgtgcagaattcgatttcaagcaacaagtggaaagccgcaaaaaaaacgtggtttgtttatagagaaattgagcgcctgcattttatcaaggcttcgtggtgttttatgcaatatgcgaaaaacgcggtcttgaaaagactgtaggcgtcagaggagctgggtgatgaaggtggaaccgattattcacgtaatcgtcggagcggcggaatgggggcatgaccggctgagatacagacggcatcggctggctgaatttcttgcccggcaaaaagaaacgaaaagcgtcatttgggtatgcccgtccccgcgagccaatgatgatcagatggccgggatcgccgagggaatccggcagttcactgtaaaggatctcatgcagcaaaaagcattccgtttcggcaggtatacagacatgtgttacaggcataaactttcaccattgttgcacatgctgaaggaagaaggagaaggggcccgctgctgcttatggtacaccttccccggtttcccgcttctggcagatctgtttccttgggatgaagtgatttacgattgcagtgatctgtgggccgctccgatcagcggccgggccggtgtgctgtcaaatgtaagaagaaacatcattaaacaggcggaaatgagaatcattcagcgtgccgattccatcacctgcacatctgactgtctgcaccgggaggtcggaaaaaagctggagaacccgcaccagaaagtgttcaccattgaaaacggagtggaatatgacctgttttcacgggaaaataaacagccggatgaagacattttacggggacgaaacggaacggttctcggttttatcggcggaatcaaaccaaagctcgattttgcgcttatggcggaaacggcagatttgcggcctgactggacgattttattggtgggcccgaacacggctcaggacgatccggatttcgagtcgcttctggaacgcccgaatgtcatctggacgggacctgccgcgccgaatgaagtgccgtcctatatgcagcttgtcgacatcggcatcatgccgtataaaaattcaccttataatgacgcggtatttccgcttaagctttttgaatttttagccgccgggaaaccggttgtcggctgcaacctttcttctacgtcaaaaatcaaaaggccttacgtttatgaatacgttgaagggagcgaccccgcagatttcatcgcggcctgcgaagcgcttctggcagcggaccgccgcggatcatacgaggctttgcgccgtgaattggcccggggacgggattggaatgttttattcggccgaatgcttgaatgcacgggtatattggaaaatgcgcaatcccattaaaagggaaagcgcattttttgatttgcgtgtttctttttgatgatgcttgttataataactagtaagaattataatggaaggaacggttcaatatcagaaaagacttcatataattccaaaggagacttctttatgcttgacgaacgcatgtttcgcatagttgttgcgttttttgtctctctgctaacggttttaatcctaactcctatcgtaaaaaaaattgcgatcaaaataggtgcagttgaccagcccagcaaccgaaaagtacatgataaaataatgccccgtatgggcggcttggccatctttatcggcgtagcggcgggtgtgctcgcggccggcatatataatgaaacgaaaatgaccgccattacggtgggtgcgtttattattgttattttaggaatccttgatgataaataccaattaagcgcaaaggtaaagtttttcgtccagctggccgtggccattatgattgtgagcacgggactgaaaatggactttttctccgtaccgtttttaacggaacgtttagaattgggatgggtcgcttacccgctgactgtgttatggatcgtcggtattacgaatgcgatgaacctgattgacggtttggacggactcgctgccggcctgtcggtcatcggactctccactatcgccgttatggcgttgtccggagggaaaatccttattctgtcactttcacttgtcgtgataggaagcacactcggatttttattttataattttcacccggcaaagatatttatgggagataccggatcgctctttctcggatacgtcatctcagtactctcattattaggtctttataaaagtgttactttattcagtatcatcattccgatcatcattttgggcgtgccgatttttgatacgacattcgccgtcatcaggcggattttaaacaaacagccgatctcagcgcctgataagtcacatatacaccaccggctgatggccttcgggctgtcacaccgcacggctgtcattatcatttatttaatcggctttattttcagcgtcagtgccatcctgctgaaaagcgcgaccatttggctttcgctgtttattatttttgtattgattgtatttatgcaaatcatagcagaggtcacagggttagtaaatgaacaatttaaaccatttaccaagttttacaaaagattggtaaagaaaaattaaaaagagcagatcatgcgaatggtctgcttttttgctattctcttattatatagaaaaacccgatcctgctcaaaggatcgggtttactcttaatagcctgttgtgccgccggactgtgtgctgtccgtaccgtttgcacctgcagtaccgttggttgaatcggttgtgccgcttgttcctgtgctgccggaagtcgaatcagccgtaccgcctgttcctgtgctgccggaagttgaatcagtcgtactgtccgttccggtgctgtcagaagcgggatcggatgccgtgctgtttccggacgggtaatccaggtgcttctgcaattcctgccgtactttctcgagattggttggatccggctggaaataatatgttccgcgcgtagttgcggttccgcctaaatataaatctgatcctgttatggtcagtgtatcaatctttttgctggtaaatccgctgtaaatctgctgaagagcgagtccttcagtgattcggatattcgtttggacattattgctcgctgtttcagcgattttatcgattttagcaatatttccagctctggacatttggtcgatcagtgcgtttaaaatttgcttttggcggtcattccggccgaagtctccgcgcttatcctgctttctcatccgcgcgtaagccaaagcctgctcaccgttcaaatgcatgtttcctttcttgaaatagatccgtttctttttactgacgtcactcatctcgtcgaagtcaaacggcacttttacatcgaccccgcctacttcatcaataacatccttaaagccattgaagtcgacagtgacatacttatcaatcggtatgcctaataagtcttcgacggttgagacggtttcatccgctccgcccttagcaaaagccgcattgatttttgttttgttgccggttgtgtcgccggcaagcgtcacccgcgtatcacgcggaatactcagcattttcattgttttatttctcggatcaagggtaacgacaataagagaatctgatcgtccgccttttccgctggtggcataattttcgatccccataaacaaaatggagaacggttttttcttcatattgatgactttatcccgcaattttgatttttctccgcgggaaagggcatcatatgcattatctgccgcattgatcgttttgtatactttgtatccgccaaatccggcagcaactaacaaaacgagggtaagcagcagcaaaatccgtttgaatatgatctttcgtttgcttttctttttctttcgaacacgcactcttacacgttcagccattacattagtctcctttagggctgacgtctgtttctaaatacgtcagttctccctctgtattcttactcttgccgttcgtcagttctgtcatccattttagaaacgcttctttgtctttttcttcaacgtacgtttcaaattcgacatgatccgcataatggatatctttcagtaaaaaaactgattctctcagttcgttctctatcttgccgagccacgtataatccgctgatgtatgcataatccgcatcagcttccgctccgtaactcctatatgatttaagccttcagacactgacttcccatatgcacgaatcaatccgcctgcaccgagctttattccgccgaaataccgggtaaccaccgcgcaggtatctttcagaccgcgttttttcagcacttccagcatggggacgccggctgtgccgcttggttctccgtcatcattggccttttgtatatggtcggtttcgccgatcagataagctgagcagttatgagtcgcattccagtgctgtttttttatcttttgtataaattcctgcgcttcctcttcagaagcagcacggctcaggtgacagataaaacgtgatttttcaatcacaatctcatgttcacccgtttctttaacagttaaatagctgtgcagcatgattgctggaccctcctgacaagcattaaaagacttgtttctacaaattcgaacagactttagaatttttgcgcatattttggtatcatgaaagagtaagatactatataaaaatgtttttttctagaatatacgcattctttcattataattcgacataaattgcagttcaattacatttataataaaaatacataacaacaccgttacggagggagacagatgaataaatcgaagatggactccaaagttttggattctatacttatgaaaatgctgaaaaccgtggacgggagcaaggacgaggtttttcaaatcggagagcagtcgcgccagcaatatgagcagctggttgaagaactcaaacagatcaaacagcaggtgtacgaagtcattgagctgggggacaaacttgaagttcatacgcggcacgcacgaaaccgcttgtctgaagtaagcagaaatttccataagttcagcgaagaagaaattcgcaacgcctatgaaaaggcgcacaaacttcaagtggaactgacgatgatccagcagcgtgaaaagcagctgctggagcgcagagatgatttagaacgccggcttttggggcttcaggaaatcattgaacggtcagaatcattggtcagccaaataaccgtcgttctgaattacctgaatcaagaccttcgccaagtagggcttcttcttgccgatgcgcaggctaaacaagatttcggcttaagaatcattgaagcccaagaggaagaaagaaaaagagtttccagagaaattcatgacggtcccgcgcagatgctggcaaatgtcatgatgagatcggaattaattgaacggatcttccgcgaccgcggcacggaggacggatttcaggaaatcaaaaatcttcggcagaatgtgcggaatgccctttacgaagtcagaaggattatatatgatttaagaccgatggcattggacgatctcgggctgattcctacactgagaaaatatctttatacaactgaagaatacaacggaaaggtgaaaatacattttcagtgtatcggagacacggagaacaaaaggcttgccccgcaatttgaagtggcgcttttccgtctcgctcaggaagccgtcacaaatgcactcaaacattcagaatcagaggaaataacagtaaaagtggaagtaaccgctgattttgtcgttcttatcattaaggacaacggaaaaggctttgatattaaggatgctaaacaaaagaaaaacaagtcatttggcttgctgggaatgaaagaaagagtagatctgcttgaaggaacgataacgatagactctaaaataggtcttgggacatttatcatgattaaggttccgttatctctcggcctataatttgttaaatagagccaaaagacatattgaccgaacagcggcgtatatagaacaataggataaggaggcgtagcgtgtgactaaagtaaatattgttattatcgacgaccatcaactattccgtgagggtgtaaaaagaatattggattttgaacctacctttgaagtggtagcagaaggtgacgatggagatgaggcggctcgaatcgtcgagcattatcatcccgatgttgtcataatggacatcaatatgccgaatgtaaatggagtagaggctactaaacagcttgttgagctgtaccctgaatctaaggtgattatcctctccatccatgatgatgaaaactatgtgactcatgctttaaaaacaggtgcaagaggctatctcctgaaagagatggacgcagatactttaatcgaagcagtgaaagtggtagccgagggcggttcttaccttcacccgaaagtaacccacaatcttgtcaacgaattccgccgtcttgcgacaagcggagtttctgctcatcctcagcatgaggtttatccggaaatccggagaccattacatatattaacgagacgggaatgtgaagtgctgcaaatgcttgcagacggaaaaagcaaccgcggaatcggtgaatcattgtttatcagtgagaaaacagtgaaaaaccacgtgagtaatattttgcagaaaatgaacgttaatgaccggacacaagccgttgtcgtagccattaaaaacggctgggtagagatgcgttagtcatgtatgagaagacttgccataataggcaagtctttttttacagcttcatatctattaaaatacttattaagtacttaataaggcaggtaaagtgatgaagattgcagttgtaacagacagtacagcatatattccgaaagagatgagagaagaacatcatattcatatgattcctcttcaagtggttttcggtgaaaaaacattccgcgaagaaacagaactcgactggagaagtttttataaagaagtaaaaaatcatgatgagctgccgactacgtcccagccttctttcggtgaattaatcgcattgtacgaagaactgggcaaaacatatgacgcagtcataagcatacatttgtccagcggaatcagcggaacttataacagcgccgcctcggcaaacactatggttgatcatattaaagtttatccctttgattcagagatcagctgtttggcgcaaggtttttatgcattaaaggcagcacagctcattaaagacggtgttgactcaccggaagagattattaaagagctggaagaaatgaaaaaaacagtccgtgcgtattttatggtggatgatttatcacacctccagcggggcgggcgtctaagcagtgctcaggcttttatcggcggtctgttaaaggtaaagcctattcttcattttgacaataagataattgttccttttgaaaagattcggacacgcaaaaaagcgatttcgagaatttttgaactgtttggggaggatgcaagtaaaggaatcccgatgcgggccgctgtcatccatgcaaacagggaagaagaagcggcggatattatacaggagttaagcggtaaatatcctcatgtcgaattctataacagctatttcggtgccgtgatcggaacccatttgggcgaaggcgccatcggaatcggctggtgctttaaaaactaagtgaaaatctccgttttcaagggcggagatttttttattattaaattttcgtgattcgacaaaaaaattcccggcaggcatactttgaacagaaaggaggcagggagatgtccgaaggtgcttcagaattttcagaggtgcgggatttcttttacggccggcatttattgagatctgagataccgttttcagatcagcgcatcaaccgttttatagaaaaagagcatataacggccgagccgtcaatcatccgccggaaaaaccgttacgtctgccaacgatgcggtcagtctgatcaagcctgctttgcggcattttgggcgccctctgccaaaaggcagattacctattgccgtgcctgtgtcatgatgggaagggctgatgaactgacatcattatattcttggaatcaagcccctgaaaacagctgggagcctgtaaagctttcttgggaaggaacactgacagacggacagaagcaggccgccgccgcgcttacagatgcgataaaagagagacaagagctgttagtatgggcggtttgcggatcggggaaaacagagatgctgtttcctggtatcgagtttgccctgaatcaaggtttgcgcgtctgtgtcgcgactccgcgtacagatgtcgtacttgaactgctgccgagactgaaaaaagcatttgagaaagtcgacgtttctgctttgtacggcggcagcgaggacaaaggccgcttgactccgctgatgatttcaaccgctcaccagctgatgcgctaccgagacatttttgatgtcatgataatagatgaagtagatgcgtttcctttttcagccgatgagacattaagattcgctgttgataaagcgaggaagaaaaacagcgcccttgtttatgtaacggcaactccttcagacacattaaaaaagaatgctgaagccggtttgctgaaaagcgttcgcataccggccagatatcatcggaaacccctgccggagccgcgttttttgtggtgcggcaattggaagaagaagcttcagaaaggaaaactgccgcgctctgtaacggattgggtccgccaaaaacttcaatcacagctgccggttttcttattcgttccgtctgtacacgtattgaaaaagacaacggattattttcagaaattaaacatacgggcagaaggcgtacatgcggaagacacattcagaaaggataaagtgaaacgattcagagacggccggcttgatctgctggtaacgactacgattttagaaagaggggttaccgtgcccaaagttcagacatgtgtcctcggcgcagaagcacctatctttactgagagcgcgctcgtacagatcgcgggcagaacgggaaggcattataaacatttcagcggtgatgtcgtcctgtttcatttcggaatgacaaacggaatgaaaaaagcaaaaaaacatatagaacttatgaacaaattggcacaaaaaagtaaattgttggactagttaatttcagaaaacatgatacagtatactcatactttcctatgaggagctgtcagcatgcttgtcaattctaaagaaatcatattaaaggaacttctcgaccgccatatgcctaagcttcatatgaaatgcacatgccgggtatgcaaaaatgatgtactggcactttcattaaaccgggctgagccggcatatgttacagataaaaagaaagttgcttatgcaaaagcagagatagttgataaacagaaaaatacggcgctgcttgtcattctggctgaatcagccgcgattgtttcggttaatccaagcgagttctgtgaaacttgggaaggagcgtaatatctctgaattgtttattgtgtgactcaccaatttcaagttcattgacttggagatctttgttttctctggcgcccgagcaagaggtatgcaccatatgcagcagccgattcgaaaaaattgaaggccccgtatgcagtatatgcgggaggcctcaggagtcaaatgaaaaatgcgctgattgtgcggcccgggaatcaaaaacggaaaagcgctttttgctgcggcaaaaccgttcggtatatttgtataatgatgcgatgaaggactcattagcccggtttaaattcaggggtgatgcgaaaatcattcaagcatttggacgtgactttgctgccggctttaaagcggcatatccatcaaatacacatactctcatccctattccgctgagcggcgaacggctggcggaacgcggattcaatcaatccgagctgctggcctctctgctcggaatgcccgtcattttccccctcatccgactgaacaatgaaaaacaatccaaaaagagcaaaacagaaaggctgtccgcagaaaaaaagttttcagcagccgaaaactcggccgaaggtatgaacgtcatcttaatagacgatatttatacgacgggcgccacactgcatcaagccgccgaagtcctgctgacagcgggtaaagcgtcatcggtctcctcttttactttaatcaggagctaaatcattctttttttctgccgatataattgatagaaatataaggcagattaaagaaggaataggagttaatacgatgggtgaattggcgaattgtccaaaatgcaatgctttattttttaaaacgaacctgcagaccgtgtgccaggcatgtattaaagaagaagaaaaagcatttgaaaccgtctataattttttgagaaagcagatcaacagacagtcgacgatgcagcagatcactgaggaaacaggtgtggatgaagagctgatcctcaagtttatcaaacaaaaaaggattcagatcagccagcttccgaatttggcatatccttgcgaaaggtgcggaaatccgatcaggacaggaaaattttgcaagtcctgtcagacagatattgagtcgcaattagaccatatgaaccaaaaaacagccgctgaattcaaagaaaaaaacagtacaaaagacacatactatgcctataataccaaaaacacctgattccctaaactaactgataacgcagtcgataaaagaattagactgcgaacagaaagcgagaggaatcctatgaaaatcaatcagtacggaacacaatccgttaatccataccaaaaaaattacgaaaagcaagccgtacaaaaagaggctgcaaagccgaaggacaaagtggaaatttcttctcatgcaaaagagcttcaaaatgcgtcagatgcggtcactaaaacacgtcaggaaaaaatcgctcagcttaaagcggatatagagagcggaacatataaaatagattcaaacagcatcgctgaaaacatagtgaatttttataaaaagcaataaaaaggagaaagtcaatgtctgcaaagccaattattgatcaactgaagcgactttgcgcactgcatgaacatctgctcacgctgtctgaggagaaaacggaagcgctgaaagcaggtaaaacaaaagagctctccaacatattgactaaagagcaaaagtatattcaggcaatcgggcagactgaggaagaacgaatcaggttaacttctcagtttctcagccgcggtgaggacaatacaattgctgcatgcatctccagaacttcaggcagtgaaaaacaggagcttgaagggttatttcactctctgtctgcgcttcttgaccgtctgaaagaagtgaatgagatgaacaaacagctcacgattcaggctttacaattcatctccggggcattcgatatgatcatgccgggtgaaaaagagaatatgaattataaagagccgcaagcggcgcgcaagcctgtcagccgtttgacattattcgattcaaaagcttagaacggaggattttcaatgccatcgacttttatggggctcgaaacagcaaggcgtgcattgagtgcgcagcagactgcattgagcacagtttcaaataacgttgcaaatgcaaatacagaaggatatacgaggcagcgcgtcacattacaatcgacgagcccttatcccgcagtatcaaaaaacagtgatctgacggccggccaaatcggaacaggagtaaaagccggttcagttgagcgcgtcagagacagttttttagactatcagtacagaacggaaaatacaaaattagggtactatacagcccgttccaattcattgtcgcaaatggaaggcgtcatgaaagagcttgacaataacggattaaacggatcgctcagttcattttggaatgcccttcaggatctggcgacgaatccggaaaatacgggagcgcgctcagttttgcaggagcaggggaaatctcttgccgaaagttttaactatatatctacctctttgactaacattcagggtgatattaaaaagaacctggataacacagctgatcaggtcaattccattctcaatcagctgaatgaccttaacaatcaaatagcggcagttgagccgagcggtatgctccctaatgatttgtatgaccaaagagacagattgattgatcaattatcttctatggcaaatataaaagtttcatataataagtcgggcggacatgccttggcgactgctgagggcacggttaacgtcgaattgctgaacgggaacaacaattctctcggaacgctgctcgacggtaacacaaaaacagtttcagaaatgaaaatcaactacgacaaggacagcggactcgtgtcgagtgtgtcagtcggcagcagtacggtcaatgcggatgcatttaccggaaaaggctcacttttaggtcttattgaatcatacggctatatgtcaaacggagaagaaaaagggctttatcctgaaatgctgacggctcttgacaatatggcgctatcctttgctgacgcgtttaatgcagttcatgaaaaagggaagacctatacaggcgaacagggtgcagcattttttgatttcagcggtgatgaagcggtgccggcaaaaggtgcggcagcgaaaataaaagtcagtgacaaaatccttgcgtctactgataatatcgcagcgtcgttaaacggagaaaaaagtgacggcacaaacgcgacaaatcttgcagccgtacagaacagcaagctgactattaacggtgaaaccactacaattaatgacttttatgaatcccttatcggaaagctgggcgttaattcacaaaaagcggctaatcttatgaacaactctgaaagcaacaccctttcagccgatgaacggagacaatcagtcagtgcagtgtctttagatgaagaaatgacaaatatgattcagtttcagcacgcttataatgcggctgcgcggatcataacgatgcaggatgaaatattcgataaaattattaacggtatgggcaccggaggaagataggagataagtaaatgagagtaactcaagggatgatcgcaaaaaattctcttcgatttatcggctcaagttatgacaagctcgatcggcttcagcagcaagtgtctacggggaaaaaaatcacgaaagcttctgatgatccggtcgtcgcaatgaagggaatgcagtaccgtactcagcttgcgcaggtaaaccagtaccaacggaatgtttcgcaaggttttacatggctggaaaactcggaatcaagcgtaaactcggaaacggatattatggggaaaatccgggacttgatggttcaggcgaaaagtgattcgaacggtgaaacagaattgaaagcaatcggtacagaaatcggccagctgaaaaagcagctcgtttctgtcgcgaatactcaggtaaacggacgttatctgtttaacggaacgaattcagatgtcccgccgatcactgaaaatgccgacggcacatatacgtacaactatgagaattataccggtgcttcggatgttaacatcaacatctcaaacggagcagtgctgaaagtgaattctgatccaaactcagctttcggaggcgtcgcacaaaatggagataatgtatttgaatttctcaactccttagaagcttctttaagcaaaggcacgctgtccgaagcagattcaaatcaaattctgtcagatatcgacggttttactgacaaaatgaatgctgaaaaatccaatatcggcgcacgcacaaaccggttggaactcattcagacaagattggaatcacaagcggcaaccgctgaaaaagtattgtcggataatgaggatgtagaaatggaagatgtaattgttgattatttatctcaacagacggttcatagagcagcgctgtcagtgaatgcgaatatcattcagccgtcactgatcgacttcctgaaataatataactatcgtcttcaatatataaaaaaagcgactcacaacagggagatcgctttttttactaaaatactataaacaggagggatctctgtgcagatgccgagattgattattgacagtgtgcctgctaaaatcggtataacctttcaaaaggaagaaatcgagatggaacagccgcccgctgacctggaaatcgagcagccgccggcagagctgaacatcgaaagcacgccggccaaactgacgattgaccagacgagggcgtgggagaacttgaatctcaaatcatttgaaaagctgaacgctgaagccgctcaaaaaggtgcggaagcctgcagcgagtttatcgcaaaaacagtcagggaagggaaggaaatggcggctatcgaaaagaaaacgggcaatgtgatggcccggcaggcagcagatgtcagtccgcccgatccattcggcgaattcagcgactttctgcctgcgcagtttctcgtcgacattgactgcattccttcaaagcttacgattgatattgaagcccgcaaaccttcaattgaagcagctgtcaataaacctgtatggaattatacgccggggaaagttcagattgatatgatgcaagaccctaaggtgacgatttcggttgatgatggcaacgcagaataaaagatgaaagtggtaaaggattgtgaaggatgataattaaaacaaaatatcacggagaaatcagaatagatgaagggcagattatctcatttgaaaacggcctgccgggatttaatgacgagactcaatttgttgttcttcctttgtcggaagattcaccgtttttggcgctgcagtctgtgaaacaggagcacatcgcctttattgtcgccagtccgtttattttctttaaagggtacgaatttgacattgaccaagcgacgcttgagcttttgcatattgaagatatagaggacgtcgaagtgatggcgattttaacgctggaagagccttttgaaaacacgaccgccaatttaaaagcgccgattatcgtcaataaaaaggaaatgaaggcgaaacaaatcattttacatgatgcttcctatgaaacaaaacatctgataggaggaggatcatgctagttctctcaagaaaagtgaatgagtccattcagatcgggccggatattgaaataaaggtgatcgctatcgaaggagaacaagtgaagctgggaattgaagcgcctcagcacgtagatattcaccggaaagaaatctacttgtcgatcctggaagagaacaacagagccgtatcttttaatactgatttattacttaacttatcctcacaaaaaaagtgaggatttttttattttcaatataaacaatggaagcggccgtccgatatatatattgtagccaatgagaggaaaaattttcttcagaaatgacgctgcgcaaatgcacaaggacgtgcgaaaaacaattcagggaggaaatacaaaatgagaatcaaccacaatatcgcggctcttaacactagccgtcagctgaatgcaggttcaaactctgctgcaaaaaacatggaaaaattatcttcaggtcttcgcatcaaccgcgctggtgatgacgctgcgggtcttgcgatctctgaaaaaatgcgttctcaaatccgcggtttagacatggcgtctaaaaacgctcaagacggaatctctcttatccaaacatctgagggtgcattgaacgaaactcacagcattcttcagcgtatgagcgagcttgctacacaagcagctaacgatacaaacacagattctgaccgttctgagcttcaaaaagagatggaccaattagcgtctgaagtaacaagaatctctactgacactgagttcaacacgaagaaacttcttgacggaactgcgcaaaacctgacgttccaaatcggagctaacgaaggccaaacaatgagcctgtctatcaataaaatggactctgaaagcctgaaagttggtacgacttatacagtatccaatgatcaaaatacattgacatcaactgacggaaaaagcactgctacttgggcggatgaagtaacagatccagatggtaaggttacaaaagcagccggctattatgatactgacggtaaagttattgcatctgaaaaattagctgcagattctaaagtaacaaaaggtatcgacatctcttcttcagctaaagctgcgtcttcagctcttacaacaatcaaaacagctatcgacacagtatctagcgagcgcgctaaacttggtgcggttcaaaaccgtttagagcacacaatcaacaaccttggtacttcttctgagaacctgacttctgctgaatcacgtatccgtgacgtagacatggcttctgagatgatggagtacacgaaaaacaacatccttactcaggcttctcaagctatgcttgcgcaagctaaccaacagcctcagcaagttcttcaattgcttaaaggttaatgacggaaagatcctggttctccagggtcttttttttatttcttcagctaactcctccttcagcaagccaaagaaccctattgacaaaatgaaacattatattttgcagttaaattattgaaaaccttttaatatgaccgatataagaataagatcatacatttatggagctgtgatatgataaacagtcggaaactcactgttgtcatagagccgtctacgactaaacgccgaaaaggagagggtacatatggtcacaagaatcacaggccttaattccggtcttgatgtagattctctggtgaaaaaaatgatggatgccgaaaagcagccgcttaataaattaaaccagcaaaagcagacgcttgaatggaagcgcgatgcttatcgggaaatgaatacccagattgccgacatgtattctactacatttaataatatgctgatgtccacaaactggaataaaaaaacagtaacaagttcggattccagtgtcagcgcggtggccgtcagtgccgaacagaatatttcaacgagcatgtctgtacagcagctggctacgccgacgacttataaatcatcaggggccatcaatttcacttcgggtcaaagccaaacattgaaattcaatgtcacaaatccgggggaaacgaagccgactgaggtaaacgtcacgatcgccgcaaccgatacgattgacgatgtcatttctaaactgaacagctcgggtctcggagtgacggctttaaaagagaaaatctctaacggctcggattatgtggacacgattgcgttcacttccaataaaacgggggaagggtttaccctttcagcaggtgatgacgcgaccaaaagctttctgaaagatcagctcggttttgccgttgatgatgcaacaaatgcactgacggccaatgccgaagggaaaaacgcgaagtttacgttcaacgggcttgaaatgacaaaaacgtcaaataactttacgatcaacggcatcaaatacacgctgaacagcgtgacggacagcaacaaaacggttacgattaacagcacgactgatacggacggcatttttaacaacattaaagatttcgttgataaatacaatacgttaattaaaagcgcaaatgagaaggtgacagaatcaaaataccgtgattataagccgctaaccgatgaacaaagagaagcaatgaccgataagcagattgagcagtgggaggcaaaagccaaaagcggtttattacggagcgacagcacgctgcagaacggtttggcggagatgcggcttgatctgtactcaacggttacgattgacgggaaaaaatatcagcttgccgatttcggaattgagacgtctgatagttatacggatcaaggaaagcttgtcattaaagacgaagcgaaactgaaacagaaaattaccgagaatcctgctctcgtggctaaactgtttaatgcagacagccctgatacagcgaaaaccaaaaacccggaggaacaggggattgcccggagattaaaagacacattaaacaaaatgcagattcaaatttcaaaacaggcgggtacggaaagctcggtatcaaccagctttgccatcggaaaaagcctggatgaaatagaaacaaatatttccaatatgaaaacgaagctggatgacatcgagacgagatattataaaaagttcagcgcactggatacggcattggagaaattgaacagccaatcttcatatctcacgtcaatgttaggatcttcaacttcataaccttgggggttttataaaaatggcaataaataatccttttgctgcttaccagcagacatccgtctttacagccgctccggaagagctgacccttatgctttataacggctgcctgcgattcattaagctggcaaggcaggcgatgaagcaaaacaaccttgaagccaaaaatgaaaatatcgtaaaggcgcaaaacatcattcaagagctcagcatcacgttaaaccgggagattgagatttccgagcagatgtcatccatttatgattacatccgccgccggctgatcgacgcgaacgtgcagaataacggagagtttttagatgaagcggaaaagctcgttactgaatttcgcgacacgtggaagcaggccatgcagagtgaacggaaaaacagccatggcgcgggcggccttgcctgatgaacagcaatgtcttttctttgtataacgaaacgaagaacatgtacgccgcactgaaggacgccccggaaagcgacggtctcatcagcagcgttacggcatttacggagaaaagggaggagatgcttgcgggcataaagccgcctttttccgaagaagaaaaaacgctgcttcagcaggtggccgcgatggaccgtctgattaccggcgaagtgaaacggattcaggatggtatccgaaatgaaataaaaacgcttaagaaaaaacgaatctaccataatacgtatttcaatccgtatcagcaaacgacaagtgacggccgttattacgacaaacgcaaataggtgagtgttttgagaagtttgaacgattaccatttggtgtcagcctattaccagcttctttttacgattgatgaggggctttgctacctgttggacacgcaggatgatttttttaagacggagggcgagcggatttacaacgatttgattcaggctttttttcatctcgattcctctcatgcgcttctgctgtctatcattgagtgccgatgcgtggagacggcgatccgctcatttgacgagatctttcaggatttcagcatgttaaatgattatgatttcccgtccgccccttttcaggagtttttaaaaaccatctttctgccgcattataagctatggatggagcagacgcacgactgtatcaaaccgtatgttcttcactagacctgctgcaagcggcaggtcttttgcctgcgtcctttgcatatacttataatcctgccggaagctgccggataaaaccgacaccattcgtcatcgttcaccgaatttacacattattttaacgtttcagcagggatcagaaggggtaaaagagaaatagttacatatccttagataaagggaggcgttctttgatgaactacaatatcagaggagaaaacattgaggttacacctgcgttaaaggatcatgtggagagaaaaatcggcaagctggaacgatatttcgagcagagcgtcaatgccgatgtgaacgtcaacttaaaattctataacgataaggaatccaaagttgaagtcaccattccgatgactgatctggcgcttcgttctgaagtgcataacgaggatatgtacaatgcaattgatctcgcaacaaacaagctggaacgtcaaatccgaaagcataaaacaaaagtcaaccgaaaattccgcgagcagggtcttccgaaacattatttcgagaacggcagcgctgctgatacgggcgtagcggttcaggacgaaattgaagatgacagcccggaaattgtccgtcaaaagcgttttaatttaaaaccgatggataatgaagaagcgattctccaaatgaatatgctcggacataatttcttcgtattcaccaacgcggagacgaatctcacaaatgtcgtttaccgcagaaatgacggcaaatacggattaattgaaccgactgaataaacccacccagccttccgtgaacgcgcggaaggtttttctctatctttatctgcaaattctttggaaatagcaaaaggtatgttatgataatgagaggtatacatggacagaaaattatcatttattccatgcaaaatctgcatgtgaacatagaggagcgttatagatgcttgggattttaaataaaatgtttgatccgaccaaacgtgcgctgaacaaatacgaaaaaatagcaaatgacattgatgccgtaagaggagattatgaaaatctttctgacgaggcgcttaaaaataaaacggcagaatttaaagagcggcttgaaaaaggagaaacgacggatgaccttcttgtcgaagcgtttgccgtcgttcgtgaagcttcccgccgcgtaaccggcatgttcccgtttaaagtgcagctgatgggggcatcgcccttcatgaggggaacatttccgaaatgaaaacaggggaagggaaaacgctgacgtctacgcttcccgtgtatttaaatgccttgacgggaaaaggcgttcacgtcgtaacggtcaacgaatatctggcaagccgtgatgcccagcaaatgggagaaatctttgcgtttctcgggcttacagtcggcctgaacctgaattcaatgtcaaaagacgaaaaacgcgaagcttacgcagccgatatcacgtattcaacgaacaatgaactcggctttgattatttgcgtgacaacatggtgctctataaagaacaaatggtgcagcgcccgcttcattttgccgttattgatgaagtcgattcaattttagtcgatgaagcgagaacgccattgattatttccggacaagctcagaagtccacaaaactgtacgtgcaggcaaatgcgtttgtccgcacgctcaagaaagatcaggattatacgtatgacgtcaaaacgaaaggcgttcagctgacggaagaaggaatgacgaaggctgaaaaaacgttcggcatcgacaacctgtttgacgtcaaaaacgtggccttgaaccaccatatcaaccaggctttaaaagcccatgcggcgatgcagaaagacgtggattatgttgttgaggacggccaggtcgtcatcgttgattccttcaccggccgtctgatgaaaggacgccgctacagcgaaggtcttcaccaggcgattgaggcgaaagagggcctggagattcaaaatgaaagtatgacattggcgacgattacgttccaaaactatttccgtatgtacgagaagctggccggtatgaccggtaccgcaaaaacggaagaggaagaattccgcaatatttataacatgcaggttgtatccatcccgaccaaccagccggtcatccgtgacgaccgtccggacttgatctaccgctcaatggaagggaaattcaaggcggtggcggaggatgtcgcccagcgctacatgaccggacagccggttcttgtcggtacggttgccgttgaaacgtctgaattgatttctaaacttctgaagaataaagggattccgcaccaggtactgaatgccaaaaaccatgagcgtgaagctcagattattgaagaagcgggacaaaaaggcgctgtcacgattgcgaccaacatggcgggacgcggaaccgacattaaactcggcgaaggcgtaaaagagcttggcggtcttgcggtcgtcggtacggaacgccacgaatcccgccggattgacaatcagctccgcggacgttcaggacgtcagggagacccgggcatcacacaattttatctttcaatggaagatgaattgatgcgccgtttcggagctgaacggacgatggcgatgcttgaccggttcggtatggatgactccacgccgattcagagcaaaatggtgtcacgcgccgtggaatcatctcaaaaacgtgtcgaaggaaacaacttcgattcacgtaaacagcttcttcaatatgacgacgtgctccgtcagcagcgcgaagtcatttacaagcagcgttttgaagtcattgactctgaaaacctgcgcgacattgtggaaggcatgatcaagtcttctctggagcgtgcgattgccgcttatacgccgaaagaggagcttccggaagaatggaatcttgacggcctcgtggagctggtgaattcaacgtatcttgatgaaggcgcgcttgaaaagagcgatatcttcggaaaagaaccggatgaaatgcatgagatgatcatggaccgcatcatgacaaaatataatgaaaaagaagagaatttcggtacagagcagatgcgtgaatttgaaaaagtcatcgtattgcgtgccgttgattcaaaatggatggatcatattgatgcgatggatcagctgcgtcaagggattcaccttcgcgcttatgcgcagacaaatccgctgcgtgaatatcaaatggaaggcttcgcaatgtttgagcacatgattgagtccattgaggacgaagttgcgaaattcgtcatgaaggccgagattgaaagcaatctggaacgcgaagaagttgttcagggccaaacgacggctcatcagccgcaggacggcgatgaggccaaacaagcgaaaaaagcgccggtccgcaaggttgtggatatcggacgcaacgcgccttgccattgcggaagcggaaaaaaatataaaaattgctgcggccggacagaatagtctcgactgtatgaagcgaacatgaccgggtctgcgtcttatggcgccccggatcttttaatgaggtgaatggaatggaattatcagaaatcagggcagagctcgaaaatatggcttctcgtttagcggacttcagggggtctctttgacctcgaatcaaaggaagcccgcattgcagaattagatgaaaagatggcggaaccggaattctggaatgaccagcagaaggcccaaaccgtcatcaacgaagcgaacggtctgaaagaatacgtgaactcctaccatcagctgagcgagtctcacgaagagctgcaaatgacacatgatcttttaaaagaagaacctgaccaggaccttcagcaagagcttgaaaaagagctgaagtcattaacgaaggaattgaatgaatttgagcttcagctgctgctcagtgaaccatatgacaaaaataacgcgattttagaacttcacccgggcgccggcggtacggaatcccaggactggggttccatgctgctcagaatgtatacccgctgggcggaaagacgcggcttcaaagttgaaacgcttgattatctcccgggagatgaagcaggaattaagtcagtcacactgcttattaaaggccacaatgcatacggctatttaaaagcggaaaaaggcgtacaccgcctcgtgcggatttctccatttgattcatcaggccgccgtcacacgtcattcgtgtcatgtgaagtcatgcctgaattcaatgaagaaatcgacattgatattcgtaccgaagatattaaagttgatacgtaccgggcgagcggtgccggcggacagcacgtcaatacgactgattcagccgttcggatcacccacctgccgacaaatgtagtcgtcacatgccagacggaacgctcccaaatcaaaaaccgcgaccgggcgatgaaaatgctcaaagcgaagctgtatcagcgcagaattgaagaacagcaggcggagcttgacgaaatccgcggcgaacagaaagaaatcggctggggcagccaaatccgctcgtacgtcttccatccgtactccatggtgaaagaccaccgcaccaatacggaaatggggaacgtgcaggcggttatggacggagatatcgatatcttcattgacgcctatttacgttctaaactgtcgtaatccgggaacacacctgcctttggcaaggtgtgtttttttatccgttctctttttccatttttcacaacagcgctttagcaaattaatacggtatttggctgttatttacttctaagccgggaagacttaaaatgctatcgagagaaaatcggagaacggaggattttgcatggatgtgaatcacaataagccgctccgtctgatcaaagattacatatatatcatgatcggcgcggcgattacgggggtcgtgtttaacgtatttttgctgccgaaccgtatagcagcggggggagtaagcgggatcagcaccattttagaaacgtttggttttgaaccggcttatgtgcagtggattattaacatccctttgtttatcgccggagtgatcattctcggcgggaagttcggaatgaagacactggtcggttccatcgttctgccgcttgccgtctttttaacaagagatctgcctgccgcgacgacccatgaactgctggcggcgattttcggaggcgtcgggatcggaacgggaatcggcatcgtgtatctcggcaaaggctccacggggggaacggctctggcggcgcagatcattcacaaatacacggggctgtcgctgggaacgtgccttgccatcatggacggattaattgtgctgagcgcgatgctcgttttcggagtggagcagggactgtatgcgatgctcggggtatttatttcaagcaaaacgattgatgtcgtgcaggtcgggttcaaccgctccaaaatggctttaatcattacgcagcatgaagaagccgtcagatcagctgtgtttaaagaaatcgacaggggtgtgacgaagatttccgcagtcggcgggtatacggaacatgaccggccgatcttaatgtgtgtcgtcggtcagaccgaattcacaaaactgaaacaaatcgtcaaacaaattgatgagtcagcctttgtcattgtcgcagacgcaagcgaggtgctcggcgagggtttcaaacgcgcgtaaacgaggttataatagcgaaggggtgcatcttacatatgaaatcaaaatgggcgctgctggcgctggttctgaccatgtccgtcctgctggcggcatgcggcggatccaatgaatcgaaaaaagaaagctctgacagctcaggcggatcaaaagcatctgcgtcagcgggtgaagaactttatcagcaaagctgtatcggctgtcacggtaaagacctagaaggcggcggaggtccgaatttacaggaagtcggcgggaagtatgatgaagctaaaattgaaagcatcattaaaaacggacgcggcaatatgccgagccatcttgtaaatgatgaggaagccgtgaagatcgcaaaatggctgtcacagaaaaaataacagaaaaaccttgcctgttataggggcaaggttttttctcggtctgggaatgaaaagaaactgtaatagtaatatgtctaaatttgacgtataatgaagtgtactgaggaaaaggaactttcagatttttcatctgtttcctgacgaatcggccataaaccgctgtatgtttgcgaactctatggctgcaagacataaataaaagattaggtgatttcatgatagagatgaaagaagtatataaatcctatccgaacggtgtaaaagcgattaacgggctgtcagtcatgattcatcccggggaatttgtatatgtcgtaggaccgagcggagccggtaaatctacttttattaaaatgatttacagagaagaaaaaccgacaaaagggcaaatattgattaatcataaagatctcgcggctgtgaaagaaaaagagattcctttcgtgcggcgtaaaataggtgttgttttccaggatttcaaactccttcctaaattgacggtatttgaaaacgtagcgtttgcgcttgaggttatcggagagcagcagtcagtcattaaaaaacgcgtgctcgaagtgctcgatcttgtgcagctgaagcataaagcgcggcagtttcccgaccagctttccggaggagaacagcagcgtgtttccatcgcaagatccatcgtcaacaatcctgacgtcgtgatagctgacgaaccgacgggcaaccttgatccggtaacatcatgggaagtgatgaagacgctggaagagattaataaccgcggaacgaccgtcgtgatggcgacacacaataaagaaatagtaaacaccatgaagaaacgggtcatcgcgatcgaagacggaattattgtgcgtgatgagtcaagaggggagtatggttcttatgattaaaattctcgggcgccatttgcgtgagagttttaaatctctcggaagaaacacgtggatgacatttgcatccatcagtgccgttaccgttacattgattttggtcggcgtgtttttagtcattatgctgaatttaaacaacatggctaaaaatgctgaaaaagaagtggaaattaaagtattaatcgatctgacgtcaaataagaaaacgcaggatacgctgcagaatgagataaaagacatttcaggaatccaaagcgtagagttttcatctaaagataaagagcttgatcaattggtcaaaagcttcggcgacagcggaaaggccatgaaaatgcaagatcaggaaaacccgctgaacaacgcgtttatcgtcaaaacgacagatccgcatgatacgccgaaagttgcgaaaaaaattgagaagcttgatcatgtgtataaagtgacatacgggaaagaagaagtcagccgtctgtttaagatcgtcggggtgtcacgcaacatcgggattgcgttaatcatcggccttctgttcacggcgatgttcttaatttcgaatacgattaaaatcacgattttcgccagaagaaaagagattgaaatcatgaagcttgtcggcgcgacaaactggtttatccgctggccgttcttcctggaagggctgctgctgggggtattcggttctgtcataccgatcgctctcgtgctgagtacgtaccagtcgatggtcgcttgggtggccccgaaagttcagggatcatttgtttcacttctgccgtacagtccgtttgtgtttcaagtatcacttgtgctcattctgatcggcgcggtgatcggagtatggggaagtctgacttccatccggaaattccttcgtgtataaataaaaaagccagtctgatacagactggctttttttaatggtttcgttactgaatgacgggcagggccggtgatccgggctttaatgtaaagtcataagacgattcgtcacggtacatcgggtccgcataaatggaatccgaatcgtttgccgttccttttcggtacgctgtgaatgaatcatattctctgttcttccaattccagatgccgtcttttccctcttctttgtgatagacgttatgattaacggtattttcttcgtttttcgtaaaatcatttgcgataaaaatccgtgaatcgcttgccgtcatgatgtttttttcgatcgtgttcccttttgtgccgtactgcaggagcagctggccgccgtcaaggtccttcgtgtcatttcggtacatgatgttgtgagcgatcaccgaattgatggtgccgccgcgtttcgtgtcatagcctccgattgaaataccggtgtatgcattgccgtacaccttgttatccgtaatccggatatctcgtgcgtatttccctttatgctcagaggtggcttcaatcccaaggtcattgttgtaaacggtgtttttcttaatgtccacatgttctgcgccgtcaacgtaaataccgcccgctgaatattcatctccgtaagcgggatttccgtaagaagagttatggctcaccgtattgttttcaatgacgccgtttcgcgcatagtcgttttgcttggacgttccttcgtatccgatcacgtcaatcccgatattgttattgtcccggatggtattgccggcaatcttaaatccgtcgacattcccgttcagcacgaccgcttcgcttgcgccgagcgtcagtttttcaaccgtattatttgtaatgctgacatccttcatggcacctgtgccgtaaaatgcgatgccgtgtgcatttccttcatcagccgtggttttaatgttccggatatggttgccgtcaatgttgatatgactgcttgatccggtgacgcagatccccatggccgtcgcatcttctgatgatacggagagattctcaagcgtaacgccgtgaatggtaatgtactgtttattgcggatttgaattaacggagtttcagaatcgctttttggcgcagatttgccgctgattgagacatgctcattctgatagttccgaaatgtaatcggcttttcggccgtgccgctgtgctttacttcaaacgtttcatcgtacgtcccttcccgaatcaatacggttgttccggcctctgccttttcagccgcatgttttaatgtgcggaacggcttttctttcgttccttcatattggtcgctgcctgcgggagaaacatacaaggcgtccgtctgcgctttctcattggcctctgtttttggccagacaaaggcggtaatgcctgcggccagaaccgccgcggataaaatcgataattttattttcatatcgcattctcctgtatatttaatgaattgcatacaaaatattatacgttacccatatatatgaaacaatctcgctttttcatttttttgttgccgttacatgaattctttgcaatttacacatactatctccaggttttcgttaaaggactaagaggaggtaaacgatgaagcagaaaatgatcgcagtgatagcggccctaagcatgatgtgcggcggagcccatattgccggggcggcacagccgaattcatcagacgcagaaagaacccgggcaatggaaaaaatcgaaaaagcatatgagctgatctcgaacgaatacgtggaaaatgtagataaagaaaagcttcttgaaggagcgattcaggggatgctgtctacattaaacgacccttattccgtttatatggacaagcagaccgctaagcagttttccgattctcttgattcttctttcgaagggatcggcgctgaagtcggtatgaaagacaataaaatcattatcgtatcaccgtttaagcaatctccggcagaaaaagcgggcctcaagccgaatgatgaaatcatcagtataaacggcgtgtcaatgaacgggaaagatataaacgaagccgtgctgaaaatcagaggaaaaaaaggatcgaaggtttctattaaaatacagcgtccgggtactgaaaaacagctgtcattccggattaaaagagcggaaatcccgcttgaaaccgtatttgcttcccgcaaagaatcaggcggtcatcatgtcggctacatcggcatatcgacattttccgagcataccgccgaggacttcgccgcggcgctgaaaaagcttgaaaaacaagggattgacggtctcgtccttgatgtaagggggaatcccggcggctaccttcaaagcgtcgaacaaattttaaagcatttcatcacaaaagacatgccgtatatccaaattgcggagcgtaacggcgataaaaaacaatatttctcaaccttaaaacataagaagccgtatcccgtcaatgtcattacggataaaggaagcgcctccgcttcagaaattcttgcgggcgcgttaaaagaagcgggacattatgacgttgtcggcgacacttctttcggtaaaggaacggttcagcaggccgtgcctatgggagacgggagcaacattaaattgacgctttacaaatggctgacaccgaagggcaattggattcacaaaaaaggcattgctccgacaatcgctgtgagccagccggattattttgcggcgggaccgcttcagctgaaacagccgcttcagcctgatatgaacagcgcggatgtcaagcacgcccaaatcctgctgaaaggcctaggcttcgacccgggcagagcggacggctatttcagcaaaacaatgaaaaaagccgttctggcgtttcaagaccggtacaagcttgataaaacagcggtcattgataaaaagacagcggaaaaaatgaatcagctgatgaatgaaaagaaatctgacgaaaaaaatgatttgcagctgcaaatggcgttaaaatcattatttgtaaaataaatgaaaaggaggcgttttttgcgtctcctgtttcttttgtcattcataaaaagtgaaccaaaagacatataattatgacggttttgacaagatattaaaaaaattttcacatttaaacatttataaaggacaaacattacccgatatttatagagaagagagactttatgccgatttaatatgtattcaaaatgaaacttttgaaagttgcctcagtcagttttagttcttacaataaaagaaggttctaatagagaacagttttagtttggcagctgcatttcagtatcgaaagcagaagtgtttgcggcgcttcagcacggcagctgtaatcacccgtgcttatctggataaaaaaatgggggttcacaattgaagagggcaagtattgtgcgtgaaaaaaaatattatgaattagtggaacaactaaaagacagaacaaaagacgtcacattttcatcaacaaaagcactaagtcttcttatgctgttcagcagatacctggtcaattacacaaatgttgaatgcgttcacgaaatcaatgaagagtgtgcgaagcattatttcacttacttaatgaaaaaccataaacgtttaggaatcaatctgacggatattaagcggtccatgcttctgatcagcggcgtgatcgaggtggaggttgaccactatctgaaagatttctctctctcaaatgtaacgttgtggatgacggaagagagatagacgtttgagatattcaagccaatgattatttggtagaatagaattaaaatgtttggcttgaggcggtgaaagcagtgtctgttcaatggggaattgaacttctgaaaagtatcggtctgttttttttgcacccgatgttctggttttttatcatcataagtctcgcatgcggatatttgcggatcaaacgtgaacgccatacgtttcatacaaagatcgcggatatgtatgacgagcttatctttacatacataaaaggacttataccgggtattcttctctccatattattttttggacttggaatttcgattccattcggtcttctcggcataatcgcggctgtgactgctttgctttcgctgacgttccgtatgaattggctgtcctcagcttatattgtcagcgccggcatgttcattgcgtttatccttcagtatacccacacagtgccgtttgcggatcggtttccgcaggcattcggcgtgaattgggcatcggcggccgtgtttatgggccttttgattatcacggagggagcggctgcctgccgttcagcgcatctgaaaacatctccggcgcttgtcgtcagcagcagaggcctgcccatcggccgacaattggcgaatcgcgcatggctgcttccgcttttcttattggtgccgggcagcgggcttgagtcacacctttcttggtggcctgtctttaccgtaccgggcggctctttccatttgatctggattccttatatcgccggcttcggacagcgtgtgcaggggtcacttccggaagtcagcataaggataacggcgaaacgtgtcatgattctcgggttatcgtgaccgcattcggggcagctgccctttggtggactccgcttgccggagctgccgcttgtattgcggtgctcggacgcctgtttttatcattgagacagcggctgaacgataacgcggctccgttttatttctctaagcgggatcagggcttaatggtgctcggcatcattccgaatacacccgcggacgatcttgagctgaagatcggtgagattattacgaaagtaaacggcatccccgtgaaacatgtatcggatttttatgaagcacttcaaaaaaaccgcgcatttgtaaaaatggagatcatcggcctgaacggtgagatccgttttgatcagcgcgcgtcctatgaaggcgaacatcatgaattaggtattttattcgtgcaggatgaacacgagcacgaagaaatgacagcattataatgtgatttttcataattattcggaatagtttcaagaactcctaaactagatttcaaaatcagttagaaagtaaaacagctaagaaaattatattttcttagctgttttattttgaaataataaaaaaataaatgaaggagaggtatggcttattggaaaggttattgctaactccaaaacctttagaagatgaatctttagcaggatatatattaagaataactgattataatggttatgttggatagggggagtacattataaaaaagcttttacttaagagattaccgttgatttcacttggagttatagcttacatactgacaaaatacgcgcagaaccatcaggattgggcggaaaaatacagtaggtctgtatatccgttattgtcaaaaatagtaggatttgtaccttcttgggtcaagttttctgttagtgaatggctcgtcgtgttggttgtgttactttttctattttatatcgtttattatgtgcgcaaggttatcatgagtaaaggtgtacgtaggatggtagtttatcgtggtgctctaggaatagttacgatctgtagcgtgatatatttttgttatactattttgggtggaataaactattacagatattcttttttgtcttataccgaatataaagaagagaactacagcaaggaggaactggtcaaattgagtaagtcgcttgccgttgaaatggaattggcaagggaaaagttagcggacactgatcttttggctcaagtaccagaggtttttgattattatgcacaacacgcagtgttctcgatgcaaatgttatcaaaggaatatcctattttggagcattctttatactcaacaccaaaaccagttgtgatgtcaaagctaatgtcgcatgcagggataaatggcatctttgtcccttttacttatgaatccaatatcaatgttaatgtgcccgttttcttggtgcctgctactatggcacatgaattggcacatcagagtggtttcatgcatgaggatgaggcaaattttatagcatatctggcatgtaagcagcaggatgatccaatgatactttacagtggtttttttctagcatttgtttattctatatctgagctaaagaaagtggatccagatcaggcgtctgatataatgtccagtctgtccaaggcggtgcagcatgatatagaacaaaatgagcagtaccgggataagtatgagggtgttatttcaagtatttcaagaaatgtaaatgatgtatatctgaaggcaaataatcagacagacggtttgaatagctatagtgatatggtgaatttgttgctggcagagcagcgagatagagaagtacaattaaatgtatcttgaatacttataggtttatatagtaatgatagtgggctcaagttgaacataggagtgagtgaaataaataaaataaaagacggcggccgggctttttacggccggattacgatgtcagcgccgaacttgatcggaactctcagccatttacattccccttttctcttgtaaatcaaaagattcttatagagcaaacggcattgcggtgacactttgagagagaaaatgaagaaggaaaactagaaaaggttccggaaagctgatgcttacggaacctttttcgttatgccgaatggctttttttcgtctgaacggtttccccggacttaattccaagcgatacgaacaagccgatcacagaaactccgatcaatatgataaacagaatatgaaacccggagattaaaccgatcagtgctgaagaaataatgcttccgaaataacggaaggtggagaaaatcccggatgcgatgccggacatgcccggttctaccgtcgcaagagaagatacctgcatgctcgtcagccccgcacctgacgcgatgcctcctacaataagcgatgccataagaaacggaacggaatgggaataaaccaaaagcagaaataagagattggctgcggccatcagcccgaaggacagaaaaatcattcttcgcgcgccccatttctgatgcagctgagctccgccccagttgctggcggacatgaaaacagaaaagactgacagcgccatgccgctgtgcgacgtgttcatgctgaagtggccggtcataaagagcggcataatcaataacacggcgtacatcattaaattgcttaacagaaccgacagattggcgctcgtaaaggtcgtgtttttaaacaggtcaaaatcaataatcggatgtttcgtgcgcagttcccgcctgaaaaatagcggaaccaatacgagaatgagcagcgcgtacacccaatagcccaaagagctttcatttttcgtcagaagaataatagatacaatgcttccggcaagcaaaacggacccgatgatatcaagcggagcgtcagacgtttcttctttatatttaggaaacatcattaatgccgtcacgagtgcgatcgcaagaaacggaatgttgacccaaaagatcgaatgccagctgaagctctcaattaatagagagccgataaacggaccgagagctgcgcccagcccggcgccgaggccgaaaaagccgaatactttcggaagccgtttttcagacacgacatggcggatgatggcgatgctgtttggcgtaagcaaagcgccgccggcagcctgaagcgcccggaagaaaatcaataagaaaagacttggcgagagggcgcaccccaatgatgcgatgagaaaaaggccgacgccccataaatacatttttttgtttccgtacatatcaccgagtttgccggcaatgggctgtgtcacggccatcacgattaaatacacggtcactacccatgtgatgctggcaattgattcgctgaatgagcgggaaatggatgaaagggcgactgcgatcatcgtagaattgatgggaacgagtatggctcccagcaaaagcgaaacgatcagcgcccattctttctttgaacccatccttcatcctccttggagccggaaaatgaccggccggtaatgcctttcatgaaaatctcagtgctgtgtttcagcatcgtttcctcagagagagtaatgactcttttccccagctgcagccggtgtataaaataaccgaaaatcatcgtcataaagacgtctgcattagcttcttcgctgccggggcttatcatatttttctttgtcagctccttaaagtaaacgattaaatgctttttcacggattgcggatatacgacaatatcctgcaggacgtcttcgaatagttccggttcgcgcaggcagatgcggaacacttcttttttttgttccaattgctgcagaagggtcgtggcgaaatgaagaagatcctcatacagatcgccttccgccttggtgatcatgctttccggaaccggcgcctgctgttcaatcatggctttcattaatccttgtttgtttttaaaattacggaaaatcgttgcttcgcttacttttgctttttctgcgatttcctttgttgtcgctgcgcggtatcctttttggatgatcagattcatcgcggcgtcaataattctcttgttcgtcgttctcaacatgtttcacctcgcgtaaatactggcaggacaagtatacacccgccctgcccgtcaataaagagggaaacctagcatgaagcgcgtttgacaattgtaatcttgccgtttgtcccgtctaccgtgacgatatctccgtcgttgagcctgtcagtcgcggcacgtgtgccgagaacggccgggagcccgtattctctcgcgatgatcgccgcatgtgacaggatgccgcccgtgtccgtaatgacggcctttgcatcctggaacagactggtccaaagcggtgtcgtcattttgcagacaagcacgtctcctgttgaaaaacgggaaaattcacttgcgtcacgaatgactttcaccggtccgcttgcgattccgcttgacgctgcaagtccgtaaatttgatgttcagtgtttttttcatcttctgtgatggagccggtaatctgttcagccgttttcagctgttccgaagtcggagtcccgagataagcgggggcttcaagcaattgatattgcttgaagagccgttttcgttcagcggctttttcctgcatcggaaccggcgacgccagcgctttctcgacttcatcgctgtataagtaccacatatcctcccgatcatcaattacgccttgtttttgaagcagctcgccgattttcagaaggcaaaggcgcgctttggcgtccagcatcgcatcaatataaaaatggtgatcatctttgatgacggatgaagacaatgtccactgataatagcggtcaaacgtctcccggaagccgtcatcttcaattctatccataaagtcggcgtagagctgttttcgtttttctatcgttttatgaaactcactgtcaaaatcgtatccgtttcggacatagttctgaatgttggccaaagcgaaataagggttttccgcccaagtttcttcaatgagatcatgacttttcacggatctccagccgtattcctgtaaaaattcgccgacttgttcaagaaagcgttttccctcatttgattgcagaagcgtctgatgcagctcatcggcatgagaaaccgtaaagacgcgccgcagctcagggctgtcttttacttgtccggaaagcagccagagctgtctgtcggtctccaatgacttattcatgacgccggccagcatttcatacagaagggaggtgttttctttctcaacctgtccgtacatagattccagtatcatgtttaacgcaacctgcggaaagacaatattgaaatgttctgcgtatccttttaaatagaagtcttgcaggtttcggaacgcatcaatggcagtctccggcgtatggtctgtatgcgccagttcgtccagcttttgataaaaaggcagaaaggtttcctgaataatattgtacatgcggtcagccaagacggggaaaagcgcttctaactgttctgcgggcagcttgtcgtccgtcttatgctgtctggaaaaaacatggccctgatgaagtttgacacgctcaatctcgatgcccatcacagggaaggccttcgtgctctctttgagaccgtattccaaagccggcacaatgagtgaagcgaataacgggctgacgggaccttctatattggactccatattgagccaaaaatctttctgatcccggggcgtcatgataaattcccgttcttcgtctgccgctttctgatcctgcgcgatcgttgtaatcggtctggcctgaagcagatagagcttattttcggcaaatccgaattcgagatccacgggataaccgtacagttcctccgtctttatcgtcagcatggcaagctctttgacgctctcgtcatcaaggcagaagcggtttctcatgtcagcggacgtctctttttccgtcacgccttcgtctttagagacgatatacatttcttttaagccgatttctttttcaatctgaaatgtgtctttattgacgataaatgtgtcgggcgtcacgctgccggagacgattgcttctccgaggccgtagctcgcgctgatcatcagttctccgtcatcatgtgtgacggggttgcggctgaaaatgactcctgaaacctcggaattgatcaaaccttgcacgacaacgcccattaacggttctgcggtgtcattgttcattttctctttataaccgctgacccgcgccgagaagaaggaagcccagcactctttcacttttccgagaaactcttcttcagttttgatatttaaataggtttcgtactgtcccgcgaaagaagcgccttcaagatcttcggacgcggaggaggaacgtacggcgacagaggcgtatgattctctcaattcataaaacgatgcggtcagctcctcccgaagctcttttgaaaacgtgccgttcataatggcgcgctccagctgttcctgatctgcttgaagcccgttgtcttccataaaacgtgtcagggcattcgtctgaatgataaaaccgccgggaacgggcagcccgtttttcgtcagtttaatcaggttcattccttttgctcctgcagagcggctcgattcttccgctttttgaaatcgcactgaatacatgcggtatgaccccctttttttcttcatccaagaaaatgatagtaaacactatcattacattgtaaagagggaggaagaaactgtcaaagatacaaagacctaaaccttctcatcctttcggctgaagaaaggtaattcgattcatctggttaatggttcaatggatttatattcacattttctttgacagatgattgaagactgccgaaaaagggtattgtgatagcaggggaacgattgtccgattcttcattttttactataatcagatgagatgaagaattcccgaggagggtttttgtgattacaaaagccgtttttgcattatgtttcccttttatgctggtcgtcctttttacgcgcgtcacgtttaaccactatgtggcgatcgctctcacagccgcactgcttttcgcatcctatttaaagggttacaccgaaacgtattttatcgttggattggatgtcgtatcgctggtggccggagggctgtacatggccaaaaaagaagcagacaaaaagaaagacaatgcctgacatggtgaatatgaaatagaatgcctgcttttacgccataaaagcaggttttttatacaaaaattgacttggtaaaaataaaccatcgaactttagttcgtatttttagtgattttgcccgtcattgtgttactatatcaataggaagatttcgtaaagaaacggaggcttttttgtgaaagatcgttttgagttagtctcgaaatatcagccccagggagatcagccgcaagcgattgagaagcttgtcaaaggcatacaggaaggcagaaaacaccagactctcctgggtgcgacagggacgggcaaaacctttaccgtgtccaatctgattaaagaagtgaacaaaccgacactggtcattgcccataacaaaacccttgccggacagctgtacagcgagtttaaggagtttttcccgaacaacgctgtcgagtattttgtcagctattacgattactatcagccggaggcgtacgtgcctcaaacggatacttttatagagaaagacgcaagcattaatgatgaaattgataaactgagacattccgcgacatcctctctgtttgaacggagagatgtcattattatcgcgagtgtgtcatgcatatacggcctcggttcgcctgaagaataccgggaaatggtcgtgtcgctcagaccggaaatggagattgagcggaacgagcttctgagaaagcttgtggatatccagtatgcccgcaatgatatcgactttcagcgcgggacgttccgcgtgcgcggagacgttgtggaaatcttcccggcttcccgtgacgaacattgtatcagagtggaatttttcggagacgaaattgagcggatcagagaggtcgacgctttgaccggagaaattctcggcgaccgtgaccatgtcgcgattttcccggcttcccacttcgtcacccgggcggaaaagatggaaaaagcgattctgaatattgaacaggagcttgaggagcgcttgaaagtgatgcgcgaaaacggcaagctccttgaagcgcagcggcttgagcagcggacgaggtatgatcttgaaatgatgcgggaaatgggtttttgctcagggatcgagaactattcaagacatttgacgctccgtcctcctggttctacgccgtatacgctgcttgattattttccggacgattttatgattgtcgttgatgaatcacatgtgacgattccgcaggtgcgcggcatgttcaacggtgaccaggcgagaaaacaggtgcttgtcgatcacgggttccgcctgccgtcagcgcttgacaaccgtccgctccgattcgaggaatttgaaaagcatatgcacaatatcgtgtacgtgtcggcgactccgggaccgtatgaaattgagcatacgccggaaatgatcgagcagatcatcagaccgacgggactcctcgatcccctcattgacgtccgtccgatcgaaggacagattgatgatctgatcggcgagattcaggcgaggattgaacggaatgaacgcgttctcgtgacgactttaacgaaaaaaatgtcagaggatctgaccgattatctcaaagaaatcggcatcaaggtcaattatctgcattccgagattaagacgcttgaacggattgaaatcatccgtgatctccgcctcggaaaacatgatgtgttaatcggcatcaacctgctgagggaagggcttgatattccggaagtgtcacttgtcgccattctcgatgcggataaagaaggcttcctccgttctgaacgttcgctgattcagacgatcggacgggcggccagaaacgcggaaggccgcgtcatcatgtatgccgataaaatcacgaattcgatggaaatcgcgattaatgaaacgaagcgccgccgggaacagcaggagcgctttaacgaaattcacggcattacgccgcaaacgatcaataaggaaatccgcgatgtgatccgcgcgacgcaggccgctgaggataaagaagaatataaaacaaaagccgcgcctaaactggcgaagatgacgaagaaagaacgccagaaagtcgttgagcaaatggagcacgaaatgaaagaagcggccagagcgcttgatttcgagcgggcggcagagcttcgtgatttactgttagagcttaaagcggaaggatgatgaacacatggcaattgaccggatcgaggtgaaaggcgcaagggcgcacaatttaaaaaacattgatgtaacgattccccgggatcagctcgtcgtcgtgacggggctgtccggatcgggaaaatcatcccttgcctttgacaccatttacgcggaaggacagaggcggtatgttgaatcgctttctgcctatgcgcgccaatttttagggcagatggataagccggacgttgatgcgatcgaagggctttctccggcgatcagcattgatcagaaaacgacaagccgcaatccgcggtcaaccgtcggaacggtaacggagatttatgattatctccggctcttatacgcgagagtcgggaagccgcactgcccggagcacggcattgaaattacgtcgcaaacgatcgaacagatggttgaccggattcttgaatatccggagcggacgaagcttcaagtgcttgcgccgatcatctcaggcagaaaaggcgcccatgtcaaagtgcttgaccaaatcagaaagcaaggttacgtaagggtgcggattgacggagaaatggccgagctttccgacgatattgaacttgaaaaaaacaaaaagcattccattgaagtggtcattgaccggattgtcgtcaaggaaggggttgccgcccggctttccgactcactggaaaccgcgctccgcttaggggaaggccgtgtcatgatagatgtcatcggtcaggaagagctgatgttcagcgagcatcacgcctgtccgctgtgcggtttttctatcggggagcttgaaccccggctgttttcgtttaacagcccgttcggcgcctgcccgacttgtgacggtctcggtttgaagctggaagtggaccctgagctcgtcattcccaatcctgaactgtcattaaaggaacacgccatcgcgccgtggacgccgatcagttcacaatattatccgcagctgcttcaggcggtctgccgccattacggcattgatatggagactccggtcaaagacctgccgaagcatcagcttgataaagtgctgtacggcagcggcaatgaacggatctactttaaatacgagaatgatttcggacaagtgcgcgaaaatgaaattgaatttgaaggtgtgctgcgcaatattgagagacggtataaagagacaagctccgattatatccgtgaacagatggagcagtacatgtcacagaagccgtgcccgacgtgcaaaggctaccggctgaagaaagaagcgcttgccgttttggtcaacgggcgccacatcggcaccattaccgagctttccgtcggcgatgcgctggaatttttcaaaaacctgacgctgtctgagaaagatatgcagattgccgatttaattttaagagagattgtggagcgtctcagctttttagataaagtcggtcttgattacctgacgctgagcagggcggcgggaacgctgtcaggcggagaagcccagcgtatcaggcttgcgacgcagatcggctcccgtttgtcaggcgtcctgtacattcttgatgagccgtccatcggccttcaccagcgtgacaatgaccgtctgatcagcgcgctgaaaaacatgagggatctcggcaatacactgattgtcgtggagcatgatgaagatacgatgatggctgccgattacttgatagatatcggcccgggcgccggcattcacggcggccgcgtcatatcggcggggacgcctgaagaagtgatgaatgatgcggattctctgaccggacgttatttgtcaggggctcaattcatcccgatgcctccggagagaagaaagcctgacggccggttcattgaaatcaaaggcgcttcagaaaacaacctgaaaaaagcgaacgccaaattcccgctcggcacttttacggcggtgacaggtgtgtccggttcgggaaaaagcacgcttgtgaatgaaattctgcataaggcgcttgcgcaaaagcttcataaagccaaagcgaaaccgggaagccataaagaaatcaaaggccttgaccatcttgataaggtgatcgacatcgaccaggcgccgatcggccggacaccgagatcaaatccggcaacttacacgggtgtgtttgatgatatccgcgatgtattcgcgcagacaaatgaagcaaaggtgcgcggctataaaaaaggccggttcagttttaatgtaaaaggcgggcgctgtgaggcctgccgcggcgacggcatcatcaaaattgagatgcacttccttcctgacgtgtacgttccgtgtgaagtgtgccacggcaaacgttacaaccgggagacgcttgaggtcacatacaaaggaaaaagcatttccgacgttctggatatgacggtggaagatgctctgtctttctttgaaaatatcccgaaaattaaacgcaagcttcaaacgcttgctgatgtcggacttgggtatgtgacgctcggccagccggcgacgacgctgtcaggcggagaagcgcagcgcgtcaagctagcttccgagctgcataagcgttccaccggccggacgctgtatattctggacgaaccgacaacagggctccacgttgatgatatcgcaaggcttttggttgtgcttcaaagactcgtcgataacggtgataccgttttggtcattgaacacaatctcgatatcattaaaacggcggactacatcgtcgatctgggacctgaaggcggagcgggcggcggcacgatcgtagcctccggaacgcctgaagaagttgtcgaagtgaaagaatcatatacgggccgctatctgaaaccggtaatggaacgcgataaaaaacggatgaaaacattgctggccgaaaaagaaacggcagccacgtaatagatcaataaaaacagcccaaaactcatcggttttgggctgttgttgttacaggctttttttctgttggggaagctgtctgcttaaatgcattaagtcctgcagaatatgggtgctgctgctgtccagcagcacttttatatattggatatcatgggaaatgggaagaggggctgctttgatctgttctaattcagccagcatttcgctgttcattcttttctgttcgcgaattaaatttcgaagactctcttccgttacttgggcgttttcgggatctttctccatttgtatgtcctccttgcatacggtcaggctttgttacatattgtaatcggttcggggaaaagattctatagtgaaatctctgaaaccaaaaattacgtataacgaagcatgtccttagcatgaaaatgaaacccgctcattcgtcatacgtatgtataaggaatggttttttatatcatggcacagggagtgtttttattgaaccgaaatcaagcgattatcgcatcaatctgttatttcagcgtgtttctcgcgccgctcattcttccgattgtggcttactttgtcgtcgatgaaaaagagacgaagcggcatgccatgcgcgctctgatttcccatatcattccgtttgcgggcttgctgattgtgaccgccggtgttgtcggcggattgattacggcccagggggagagtatggtgcccgtttttgttatgataacaggagcagctgtttattttctgatcctcatcggaatggtcatttggaatatcgtgcagggaattaaggtgttacgccaggtgtaagaaaagtcgggggaggagttttgtatgaaacaggagaaagaacggattttaaagcttgtggaagacggcatgctgacggcgcaggaagcactgacgctcattgaaaaactggatcatgaatataaagaaaaagaagatcagatcaccgcattatctgcggaggttcaggaacctgcggaagatttcgaaagcggtgcaaaaggaagccaaaagccgtcgctcggggcgaagctgttcgactggattgattctgccgtcaaaaaagtgaaggaagcggatcttgatctgaatttcggccacgcacacgaagtgcagcatatttttcaatttaaagacagtgaattctcggccattgatatgcagattgcaaacggcagcgtcaatatcgtgccgtgggcggatgaagatatcagagcggagtgccaggcgaaagtgtaccgggcggacagtcaggaggcggcgcgcaccgcatttcttcagcatattgagtgtgaagtgaagggcaataagttttttgtccgcacggaaaagaaaacgatgaaaaccaatgttacgctttatgttcctcagaaagagtacgataagataagagtgaagctgtttaacggaccgatcagaggggaacatttacatgtaaaagaattctcggcgaaaacgacaaacggcgttctgtcattctctcatttgacggctgagaaagcgtcggcggaaacggctaacggacaaatcaagctggccggacatcaatgcggcgcgattgaagcggaaacgatcaacggcttgattgatttgcgcggatcgagtgaatccattgacgttcaaagctttaacggcaatatcatgcttaccgtgacagcgccgcactgccgctccatctacacgaaaacgacgaccggaaacgtggagatcgccctgcctgatgattcggcggtgaaagcggagctcaaaagcaatctcggctctctcagccatgagctgattgatgcggaaattttaaaggaaaagaatgataccattcaaaaagaactgatgctggcatcaaatcaaggccatgatcagcatctctcgattttctcagaatcgttaacaggagccattaagctcaagcatactcagaggtgattggatgaaaagactttaccgttcagaaaaaaaccgtaaaatcgccggcgtcgtcggcggtttggcggagtacatcaatatggatgcgtcgcttttgcgcattatcaccgttgtattagcgcttgtcacgagcggaatcgtgccgattgtatatattatctggtgttttgttgtacctttagaaggagatttgaaataaatgatcaaatgggcagtcagcattttagtaaatgctttattattaatcgttatcgcgggatattttgattccgtccatatcagcagtatcggagcggctgtcatcgccagtgtgattctttctgtgttaaatgtgctgatcaaaccgatcatcgtcatattgacattgcctgtcacggttgtgaccctcggcctctttctgtttgtcatcaacgccattacgttaatgatgaccgcagccttgatgggagacagctttcagattgacgggttcggcaccgccatttgggcatccgtcgtgctgtccgttttccacttgctgatccaaaaaggcatattggagccgcttagaaaaggataaaaaacaagctgtcccgagagggcagcttttttatgtgcggtttacataagcggcagcctcctgacgcaacataatgcatagggaggtaatgagatgaaacttgtgatgacgctcttttttctgattggtttgctttgtgtgagtccttctgcggatgcggcgcgcaaagaatcggcaatccccgtgaatcagcaggaattcggacagccgcctcattacataccgcttctggagaatcctccccaaatcgaagtaaaggcggaaatgaaaagaaacctgttcatacaggctcatgtacggaatgctgactatcaagcgttttcggcgtttcttttttataaacaaagcaatgagctggggtttaagatggtgccgatggagcccgcgccaggcgcaatccggctttttacggcccaggtttcaaaacgggatatctggaatggagaattggaatattacctcgttttcaccaacggcagacagcgggcggaatcggagaaaaagcggctgaagctggacggctatcaagccgatttgaatcatattcccgagctgatgattacggagcttgcggttgatacgaaaaatgaagatggcgctgatgcctatgaatttatcgaggtgtataacacgacggacaggcccattcattttaaagactatcatatccgctaccgctatccgaaggaagggccggaatcagatatgatatggaggccgaaagaggataccgtcattccgtcaggcgggacttacgtgttttggctgagacgcgccgcatcagaactgacgatagatgatttcaaccgctattacgggacacgtctgaaggaaggagaacatctcgccgtcatcgaagggacagacggaatgtccaacggccgcccgcgtacggtcgtgctgtcggcaaataccggcaaggatatcgcctcagcgcaataccggaaacacgctttccgccggctgacttctttgctgtacaaatatccgctgaacggaacgggagaattgctgaagatctccacgagcgagcataagccgtcaccgggctccgtttttcaggcgcagattccgcagcagaaaagggtgatcaaacccgacaaggaaaaaccggtcatcgaagaccttacagacagaaagcccgtccggcccgctgaaagcattgaattaaaggctgacataaaagacaaaaaccttgtcaaaacagccgcgttttattaccggaccaatgagaaaaaaccattcaaacgaattctggccgaaaaagaccgcaacgacagcttataccatcacattctttattccccggaactgctcggccaggatcagcttgagtattatatcgcagccagtgatggagaaaatgaagcaaaaacgcccgtcaagatgattgacattgaacagacgagcaaatcacacggactcagaatgaatgttgaaccggaagatacgatatccggcacctatctgctcaaagcgacttccgacgtcagcgccgataagatcaagctgtggattgacggcaagcggcaggagacccggccggcgctggaaaaagaggtctatttcgccttcgatgcccggaaaacgaatctttattttcaaaacaccgtcatgatggaaaacgaggtgctgcacatttttgacgatccgtctcaccgctacagaacgcactcggttctgcttccggaacgtctgctgctaaaagggggcaaaacacagaaagtatccatccgttcgggctcaaaggtttctccgtatgacacgggagagaatcgggatgattttgtcgtgaaacatgcccgtctggtgctttcggacggaacggtgatcaaagacgggaagacggacccgtccgagcagctgtttatcggtgacggcaagcgggcgaatcagcagaagaccttctcattcagcctgccggatcatttgtttacgtcacggctgctgccgtggaacacggcgaagctttcggaaggctatcaccatatttttgtcagtgacggtgaggagcagctgagccaatctgtgagggtggacaattcggggccgaagattgtcccgggtattaaagaaggcgcggcgctgaaaggtaatgttgagctgaatgcggacatccgtgataaatggagcaaagtggaagaggtgaaagcgtttttggacggagaaagcattacgctcccgcatcacacgtcatcagccgatctcaagcccggaaagcacacccttactatcattgcggcagaccttgccggaaatgaaacaacgtccgtccgcaccttccatatcaaacgggaggagccgaaccagccggagcttgccggtcaaaaaatcggcgcccgcaaagcaaagctgtccgtccgggtaaaagacccgacgaaggatgacatgaatgtatcattttatcgcggcttccgttataccgcgcggaatccgggcagcgtgaaagtgtataaacacgcctcattaacggaaccgccgaagggcataaaagaaaatgaaatgccgtttaccctgccggaaatgaaccgtatctcggcaaatgacggaaaaaccgtttcggcggaaagtgtggagcgttttccttatcaccggttcgaagtctccgttgacccgtctatcgacgaaacggatctggccgaggcggtctggaaaggaagctctctgcccggccgaaaggtaaccatgtatatttggaattaccggacaagccgctggcaggaggcggacagcgtccttgccaaagataaaaagccgtttacattaaaagccgccgtttccgcagcggatgtggtgaagaactcaaaaatgaatgtcatcgtgcaggatcaaataccggcgaaaggcaattacacgtttgtctggatgtcggatacacagtattacgcacaagggcacccgcacatttttgacaaaatgacggagtggatcaaagaaaataaggaaaagcacaatattaaatatgtctttcataccggtgatattgtcgatgattcaatggtgatgaaacagtggaaaaacgccgatcactccatgcggacgcttgacaaggcggggattccgtacggagtgcttgccggcaatcacgacgtcggccataaagacggcacataccgaaccttcggggatttcttcgggagccgccggtttgaacagaacatgcattacggcggatcatacaaaaataaccgcgggcattatgatctgctgtcggcaagcgggaacgattttattatgatttatatgggctggggcattacggaacaagagattgactggatcaatcaagtgctgaagaggtatccggaccgaaccgccatcttatgctttcatgagtacttgcttgtgagcggaaatcgaagcccgatcggggagacgatctatcgaaaagtcgtcaagccgaatcgcaatgtggcgatggtattaagcggccattaccataacgccatgaaaaaaaccgatgcgcttgacgatgacggagacggaaaaccggaccgcctcgtccaccaaattctgaccgactaccaggacggtccggaagggggcagggctttatgcgcataatgcaatttgatcaggccgccaatcaggttcacatgttctcctactcgccgtacacggatgacatcaattactatgacaccgatctgttcgctgataaagacgaattctcagcagaaatggatttacagccgaagaggaaaagggtagcgactgattattttgaatgcaacgtttatacgaacgaactgctcggtcataaaaaacacgtaaaaagcggaaaaaccgcaaattgggtctgggacggcctgcagcctgattccgtttattactggtacaccgtcgtgaaggacccgtacaacggcaaaacaatatcaccgctgtggatgttcaaaacgggaaatacgccgtatcacccggctccggatcagtttgatttcaggcatgcctcaaacccatagcaaaaacatacacctgccgatcggtcagaagaaaatctgacggtcagcaggtttttttctgtaacatgcatggcggtaagtgtttttgacttttttatgtcccttttctatactaaaatcgattggttttcgtaatatgcaggaggaaacataatgaacagtaaaaccgggacaaaagaaagaattattcaaacctctgcatatctttttcagattcagggataccatgcgactggtttgaatcaaattataaaagagagcggagcacccagagggtcagtgtatcatcactttccaaacggaaaagaagaactcgccattgcggcgatcaaatatacgggaagatgcgttgaaaagcagatacagaatagtatgtctcaatccgcggaccctgtagaagcgattcagcactttattcatgtaacggctgaacagtttaatgatccgcagaatattgagggcgtgccggttggattgctggcgggtgagaccgctctgatcaatgaaacgttaagatgcacatgtgttgaggtgttcaagaagtggacggatgtgtttgcggcaaaatttcttgagcatgggtttgaacaagaggaagcggagaagcttgggatgacaatcaactcgatgattgaaggcgcaatcatgttttcattggctcataaaaacaaagaaccgctgctgctgatttcaaagcaggttccgtatattgtccaaaacagaggatagcattttattactcttttctttataaaaatagataccggaaccccagcctcttcgttttgacagagtcatagagaacattcaccggcttgatttgaaaatggcagatcaaaaaaacatctccaacccgtaacggttggagatgtttcatttcaccctgtccatataatgcacgaatgtgtagcggtcgcctctgtaggcggatttgacgtgctcaaaggcagtgccgtcctgcagataagtggtccgcttgatatagaggacgggggcgccgggctggataccgagcagctcagcttcttcctcggaagcggttcccggttcaagctcttgttttgcccgtgagatcggcatctgattgtacgcttcaatatgctcatacatggatgattgaaaatgggaggcatccaattttcccgccttgtcaaacgggatatacgatgcctcaatcgccatcgggatatcatttgccagccggacgcggatgattttatgaagcgttgccggatagccgcaccccaggatagaagataattcttccgtcgcctgaatcagctggtattcggcaagtctactccccggcttcatgccccggcttctcatatcttcggtgaagcttgtcagcccttgaagcggctgttccatcttcagtttgctgacgaacgttccccggcctttctgtctgtataaaaatccttcattcaccaaattggaaagcgcctggcgcaccgtcatgcggctgatgccgaattgttcggcgtattcccgctccgacggaagcagcgcatccgctttcagctcgccgtttttgatttgtgtttttaattgttccataatctgaaagtaaatcggaatcggagattgtttatcaatctgcataggtcaaatcctttcaatcgccgcccgcagccttttcatcaatcaagaccgtcacatccggatgcgcgtgcagggcggaggcggggaatgcttcgctgacgcgcccgtccagaagctgcttcaccgcttgggccttgctttttccggatgccatgatcagaatccgtttgccggacaaaatcgtcccgatccccattgtcagggctttttcagggacttgatcaattgacggaaagtaccgcgcattcgcctgtcttgtctcttcattcagctcaacaacatgggttcgggattcaaatggcgtcccgggttcattaaagccgatatggccgttgtgtccgatgcctaaaagctgtatatccgctccgccgagtgtttgaatcaatcggtcatagcgcccgcattcggcatcaagatcgtctgcccgtccgtcagggagaaagtggcggtcctttcggctgtcgatatgtgcaaaaaaatgtgtattcatataataatgatagctgtttttgtcctcgggagaaagcccggcgtattcatcaaggttgatcgtcgtgacattccggaacgacaagccttctgagcggtgcatccgcacaagttctttgtatacgccttcaggagtgcctcccgtcgcaaggccgagaacggcatccggcttttgtttcactgtttcagcgataatcgctgcggctttttcacttaattcttcataatgtctgcatgtgataacgttcatgtccaatcagcctcccttgagatatatgcggtgtttccgcggcaaatcgtggccagcacgccgcactgtccgtccgtcagaacaacgtcggcgtcttttccttcggcgatgcttcctttacggtcgaatatgccgaggcggcgggccgcatttgccgatgtcatatttgctatatccggccatgagcagtttgtaaacctgcgcatgagcgccgcgccttcattcatttttaaaatggaaccggccagcgtcccgtcagagagaagcgccgtgtccccgcgaacggtgactttttgtccgccgaattcgtattctccgtccttaagcccttttgcccgcatggagtctgtaatcatgatcaggttttggcttcctttcgccaaataggcaagcttaacagccagaggatgagaatgaatgccgtcagtgatcagctccgccgtgatgcggccgcaggcgagagccgtaccgatgcccccggctcacggtgatgaaaggagctcatggcgttaaagaggtgcgtcatatgcaccgccccggcatccgccgctttttgtaaaagctcggctcctgcgtctgtgtgtcccattgaggggatgatgttttggttttttaaataacggatcaggctgaaatcaggatcttcttccggcgcaagcgtcacgattttgatcagccctcccgagagccgctcccatttctgaaagagcccggcatcagcaggagtaatccattgtttcggctgtgctcccgcctttttcggagagacaaacggtccttctaaatgaatgccgatcaactcagcgcctttttgggtctccggtgaggaatacgcccattttttggcgttgatgagcgctttttcaatgttttcgtgctgctgtgtgatcgttgtcgctaaaaaagcggttgttccttcttcgggcagccgggcggacagtgtatcaagagccgcaacatcggcatccatcgtatccgcgccgtatccgccgtgaatatggatatcaatcattccgggaagcgcatacgagccctcgggcgccttccattccttctcatacgtttcttgcggccttgtttttcccgcgtaagaaatgatgccgtcctttataccgagaaaaccgtttcggatgatttctttttctgttacgatgtccgcaccgctgattaacaagctttcagccactttaaaacacgcctttctggttagttgttagttttattttactccttttcagactagttatctagaccagttatgccggaattgtataaatctgttttggttcagacggtaaagtgataaaatataactgttcaaagctcggaacatcccagaacaggaggaacatatcttggcaaaggttcggaccaaagacgtaatggaacagttccatttagaattgatcagcggagaagaagggattaaccgcccgattacgatgagtgatttatcacggcccggtattgaaatcgccggttattttacatattacccgagagaacgggtgcagcttttaggaaaaacggagctgtcatttttcgatcagcttcccgaggaagataagaaacagcggatgaaatcgctgtgcaccgatgtgacgccggctatcatactttccagagatatgccgatcccgccggagcttgtagaagcttccgagcaaaacggcgtgcctgtgctcagatcccctctgaaaacaaccaggctgtcaagcaggctgacgaattttcttgaaagccgtctcgcgccgacaacggccattcacggcgtgcttgtggatatatacggcgtcggcgtgctcattacgggaaaaagcggcgtcggtaaaagtgaaacggcgctggagcttgtcaaacgaggccatcgtcttgtcgcggatgactgcgttgaaatccggcaggaggatcaggatacccttgtcgggaacgcgcctgatctgattgagcatctgctcgaaatcagggggctcggcattataaatgtcatgacgctgttcggggcgggcgccgtcagaagcaataaaagaattacaatcgtcatggaccttgagctttgggagcaaggaaagcaatacgaccgtctcggacttgaagaagaaaaaatgaaaatcattgatacggaaattacaaaactgaccattcccgtccgcccggggcggaatctcgccgttattatcgaagttgcggcgatgaacttcagattgaagcggatgggcttaaatgctgccgaacaattcacgaataagctggcggatgtcattgaggacggcgaacaagacgaataggagttggcaataatatgaatgaagctggaacaccgatcaatccgattgccttgcagctcgggcctttatccgtgcactggtacggcatcattatcggcgcgggcgcgttattagggctttggatggccatgagggagagtgaaaagcgggggctgaaaaaggacatttttattgatcttgttcttttcgccatcccgatcgcaatcatttgcgcaagggcatattatgtgcttttcgagtggagctattactcggaacaccccggggaaatcattaaaacttggaaaggcggcattgcgattcacggcggattaatcggcgcgatcgcaacgggaattgtcttttcaaaagtaagaggcatctcattctggaagctggcggatattgccgcgccgagtattctgctcggccaggccatcggacgctgggggaactttatcaaccaggaggctcacggtggagcggtcagccggtcatttttggaaagtctgcatcttccggatttcatcattaatcagatgtacatagacggacaatattatcacccgacgtttttgtatgaatcgctgtggagttttgcgggcgtcgtgattctgcttctgctccgccgcgtgaacctgcgcaggggcaatctgtttttgacgtatgtgatctggtattcaatcggcagatactttattgagggaatgcggacggacagcctgatgcttacgagccagcttcggatcgcgcaggtcatttccattgtgctgattatacttgcgattattttaatgattttcagacgcatgaaggggtatgccgataagcggtatgctgacacggactgacgactgaaatcggaaaggacataagatgactgataaacatgtaaccgccattttattcgatctcgacggcacgctgattgacacgaatgaactgattatcgcttcttaccttcatacgcttgatcattattgcccggggcagtttaaaagggaagatgtacttccgtttatcggcccgcctctgtacgaaacgttttcaggcattaatgccgaaaagtgcgatgacatgatcagcatgtacagagcattcaaccataaaaagcacgatgagctcgtcacggagtacgaaacggtttatgaaacgctggatgaattgaaaaaagcgggctatcagcttggtattgtcactactaagctgagggatacagtcaatatgggattgaagctgacaggcatcggggcgtttttcgatactgtcgtcacgcttgatgatgtaaagcacccgaagcctgaccccgagcctgtgcggcttgcgctcagccggcttgggtgcgatccgtcggaagccatcatggtcggtgacaattatcacgacgtcatggcgggaaaaaacgccggcacgaaaacagccggcgtcgcgtggacgattaaaggcgcacagacgctttccgcctatgaacccgattatatgctcgagaaaatgagtgatttattgcacatcaccggagtgaagtaatccgtgagaaaaacagaccgccatccggttgcaggtgcaaattcattgtggcatgtttatcagacggttcccttcctgaaggtgatgaaaaatttcatcatcattcagattgcaaggtatacgccgtttttaagcgtgaaaaactggctgtaccgaacctttttgaaaatgaatgtcggaaaacagacgtcattcgcgctgatggtgatgccggatatcatgtttcccgaaaaaatcactgtcggaaaaaacagcattatcggctacaatacgacgattttggctcatgaatatttaatacgtgagtaccggaccggttttgtcacaatcggtgacgaggtgatgatcggggcaaacacaaccattctgcccggcgtcaccatcgggagcggagccgttgtatcagccggcacgctggtgcacaaagatgtccccgccggggcgtttgtcggaggaaatccgatgcaggtgatttatacgcacgaagaaatgaaaaaacgaatggaaaaccccgcagattaacgtcagcggggttttttatgacttgatcacaatggcctggctgcccatctgcttccaggctttttcaaagtcagaccggtctgtttttctgtttttatagccgtaaggatcattaacgtatacataatcgtgatcataaccggttacggctacgctatgcatgctgaacgtaatgtcgatctttccgttcggtgtatcccaagtctgcatatgatcaaccggcttaaaggatgtggtggtaatcacccagaccggccgccctttttcaagctggcggtacactgaagaaatgtcttttcccgtaagatcgtatactttgtttcccgcatattctttggcaagtttatcaatcggctcatgataaacgcctaaacccgggccgttttccatatctccggcaaatccttcattcggatctcccttcagcccgctgctgtatgtgagcggaactttattgattttatccgccaatgtattttttgacacatgatatccggcattgttcaaaatcatggcaaggctggtcacctcacagccattgtacagtctgggagaatccatctgtctgtacagaacgacattcagcggtgacgcgctcccttttaacggtgttttctcatcaggctcgtcggactgctgattgaaaaaatttaaatgaatatcgtttgtatagatgttatatcccagatagacaaggatggctgtcagaatcagcacacataatgttccaagcgtcttcattatcaattattctcccttgtttctgatgaagctgttctatgtattatagcacttctgctcaatatgattcgatcgttccgatatgtttacaggtttgttcattctttagccatgtttatggaaaagaataggcggacattgggcgttgcaatccattcttttatctgctaacatattatcatattagcgaactaaaggattcggaattttccttcagacaaagcggaggtgtaaaaggcaaatgtttatgtttgagaaaccgcatggcatgagagatacgctgcccggtttatacgaagccaagaaaaaagtccgttccacactgacggatttaattgataaatggggttatcagtttatggagacgccgacccttgaattctatgaaacagtaggcgtccagtcagccattgaagaacagcagctgtttaagcttctcgatcaggacggaaaaacgcttgtgcttcggcccgacatgaccggaccgattgccagggtggcggcatctaagctgcacaaacacaatcatccgctcagagcggggtacgcggcaagcgtctatcgcgctcaggagcgggaaggcggacgtccggccgaattcgaacaggtcggcgcggagctgatcggcgacggatcaacaagcgcggacgccgaggtgattgcgctggcggccggcgctttgaaaaacgcgggattgcaccggtttaaaatcgcgatcggccatgccggactcgctgatgagctgtttgtcgaggttttgggcaatgccgagcgggcggatgttctgcggcgctttctctttgaaaagaattacgtgggatacagggaacatgtcaaatcgcttccgctttcttcaatagacaaaagccggctgctcgcacttttggaattgcgaggcgggaaagagatttgcgccaaagcggaggagatcatcggaatctccggacaaagcttaattcaggagctggaagacctgtgggacattcttgaggattacggatgtgccgagcatattcgccttgatctgaatatggtaagccatatgagttattacacgggaattttattcgaagtgtacgcggcaaatgtcggtttcgtcatcggaagcggcggacgctataacaatctcctcggccatttcggcagtcccgctcccgccacgggcttcgggctccgtatcgacaggctgattgaagcgctcggcattcaggaagaaacaagtgaagcggacgccgtgattttcagcaaggagcagcgggcccaggctattttattcgcggaggaagaaagggcgagaggcagaaaagtcgtcctgcaggatctggcgggcattgaaaatatcgatcatatgacaaaatcattcgcaaacgtcacatactttatcggtgccagaaaggaagagaggaatgggtaaggtactcacaatggcaatgccaaaaggacggatattcgaagaagcggccgggttgctgaggcaggccggatacaggctgcccgaggagtttgaagaatcgagaaaactgatcattgacgttccagaagaaaatctccgctttattctggcaaagccgatggatgttacgacttatgtcgagcatggcgtcgctgatgccggtattgccggaaaggatgtcatgcttgaggaagagcgtgacgtgtatgaggtgctcgatctgaaaatcagcaaatgccatctcgccgttgcggggcttcccggggcggattggaacggagtcgcaccgaggattgcgacgaaatatccgaatgttgcgtcgagttatttcagagagcagggcgagcaggtggaaatcattaagctgaacggctccattgagctggcgcctttaatcgggcttgctgacagaatcgtagatatcgtatcaaccgggcggacattaaaggaaaacggtctcgttgaatcagaacatatttgtgacatcacatcgcgttttatcgtcaatccggtcagctaccgcatgaaggatgatgtaatcgacgaaatggcggccaggctggcacgggttgtggaaggagaaacggcaaaatgaacataaccgcagtaaaaagaagcgagcggttttcactgaagcgttccatcgacagcggaaccgaagagcagcggaaaaccgtcagggggattattgaagacgtcagacaaaacggtgacaaagccgttttggcctatacaaaaacatttgacggcatcagcctgaaccaaatggccgtgagcgcagaggaaatcaccgaggcataccgtctgcttgatgatcagctgctggaagtgatcagacaggcgattgccaatattaaagaatatcacgagcgccagctgcaatcctcttggttttaccatcgcaaagacggctcgatgctcggacagaaaataacggcgctcgattccgcgggcgtatacgtgccgggcgggacggccgcttatccgtcttccgttttaatgaatgtcatccccgcgctcgctgcgggagtggaacggatcgttctcgtcagtcctccgggaaaagacggccgcctttcaccgggcgttctggcggcggcgtctgagctcggcataaaggaaatttacaaagcgggaggcgcacaggcgattgccgcgctcgcttacggaacggaaacgatacagcctgttgataagatcacgggccccggaaatatatttgtagcactcgcgaagcgcgaagtcttcggcgttgtggatatcgacatgattgccgggccaagtgaaatcgtggtcctggcagacgatacggcggtgcccaaagaagtcgccgctgacctgctttcacaggccgaacacgatatgctcagttcaagcgtgcttgtcaccgattcacagaagcttgccgaagcggtatcagatgaggtgaataaacagcttcagaccctgccgcgcaaagaaatagccgaagcgtcgatcagggatcacggccgcatttatattacggaatcgatggaagatgcggtggacacggtgaatgagctggcgcccgagcatttagaaatcatgacgcattcgccggaggctttgcttggaagcatcagacacgcgggggcgattttcttaggacgatacagcgctgaaccggtcggcgattattttgccggaccgaatcacgttttgccgacaaacggaacggcgcggttttcaagcccgctgaatgtaacagattttcaaaagaaatcgagcatcatctcttacagccggaaggcatttgaaacgcacgcggacagcatttccgccttcgcgagactggaagggctggaagcgcacgcaagatcgattgaagcgagaaacggaggaatgaccgatgagaaaagcggaacgcgccagaacaacaaatgagacggatataaggctggctttcgaaatagacggagaaggaaaagccgacatcagcacggatgtgccgtttatgactcatatgcttgatttgttcacaaagcacgggcaattcaatttaacggttgacgcaaaaggcgatacggagatagatgatcaccatacgactgaagatatcggcatctgtttagggcaggcttttttggaggcgctcggtgataaaaaagggatcaaacggtacggatcagcgcttgtgcccatggacgaagcgctcgcccaagtcgccgtagacctgagcaaccggccgcaccttgagatgcgcgctgcatttccgcaagcgaaagtcggaacgtttgataccgagctggtacatgaattcctatggaaactggcgctcgaagcgagaatgaatctgcacgtcatcgttcattacggcacgaatacccatcatatgatagaagccgtatttaaggcgcttggcagagcgcttgatgaagcgtcatccattgatccgcgcgtcaagggtgtgccgtctacgaaaggaatgctgtaaatgatcggtgtaattgattacggtatgggcaatttattcagcgtgtcgaaagcgctggaacgcgtcggcgtcccgtatgtcgtatcagaccggccggaagagcttgaaaaagcggatgcttttattcttccaggtgtcggatcattcagtgacgccatggacaatttacgcagcacgaagcttgatcaattcatacaccgtatggttgacgagggtaagctgctcctcggcatctgcctcggcatgcagctcattttcgaagagagcgccgaaaacggctctgcaaaaggacttggtttattagccggaaaagctgtgagactcaaagacagagatgccgaaggaaacaagctgaaggtgccgcatatgggctggaaccggctgacgtttcaccaaacgtctcctttgctttcggaagcggaagaaggcttcgtttactttgtccattcctattatatagacgggatggaagacggcgatcttctggcaagcgctgagtacggcgttcgtgttccggctgtcgtcgggaaacgcaatgttttcggtgcacagtttcatccggaaaaaagcggtacagccggaatggcgatcttaacacaatttacaaaaatggcagcggaacagaaggtgaagaaatgaacgcttttacattatatccggcaatcgatatgagaaacggcaaatgcgtccgcctcatccaaggcgattacggcaaggaaacgatatacggtgactctcctttagacatggcggcgcaatttgcacaagaaggcgccgaatggattcatctcgtggatcttgacggcgcgaaagcaggcaggaaagtaaacgacaggcatgttcttgacattgcgcggcagcttgatgtcaaagtcgagatcggcggcggtatccgttctgaagcggatgtgtacggttatttatcacaaggcgttgatcgcgtcattctcggcagctcggccgtttccgatccggcatttgtgaagagcatgctgaaacaatacggcggcaaaatcgcgatcggccttgatgcaagaaacggatatgtctcgacggaaggctggctggaaacatcctcggtaatggcggccgatctgggccgtgaattggcggccgaaggagcggaaaccttcattttcacggatattgcaactgacggcatgctgtcaggaccgaacatcgaaagtaccgttcagctcgcaaaagcaacgggaaaagacgtcatcgcttcaggcggagtcagctcagtcgccgacctcaaagcactggcccgcttcaaagacgccggcgtatcgggagcgattatcggaaaagcgctgtatacaaaacaattttcattggctgaagcgctcagaagggtgaaggacgcatgatcacgaaacgaatcattccgtgtctcgatgtgaaagaaggacgcgtcgtcaagggcattcaatttctcgggctgaaagatgcgggcgatcctgtcgagctggccgaagcctacgacagggagggcgctgacgaacttgtttttctcgacatttccgcctctcacgaaggccgcaagacgatgacagacgtcgtagaacaagttgcggcaaaactggcgattccgtttacggtcggcggcggaatcaatcaattaagcgatatgaaacgaatgcttcgcgccggcgctgacaaggtatccgttaatacagcggccgttctccgtcccgagctgattacggaaggagctgagtttttcggctcgcaatgcatcgtagcggcgattgacgcaaagtatgacgaagattcggaatgctataaagtgtacacacacggcggcagacagaaaaccgagcgggaagtcacggcctgggcaaaagaagccgtcagccggggagcgggtgaaatcctgctgacaagcatggacgcagacggtgaaaaaacaggctttaatcatacgctcacacagcttgtctcacgtgccgtcccggtgcccgtcattgcgtcagggggagccggcagcgcgcgccatatgcttgaagccttcacagtcggtgaagcggacgccgcgcttgcagcttctattttccattacaaagagacatctataaaagaagtgaaagattatatgaagaaacacggggtgaatgtgagatgaaacaggcagatgaactgcggtttgacgaggccggactgatacccgccatcatacaggatgcggcaagcaaagaagtgctgacactggcttatatgaaccgagaatcctatgaaaaaacgatagaaacgaaagaaacctggttttacagccgttcacgcggggagctgtggcataaaggagcgacatcggggaatacccaaaaggtgaaagccatccgttatgattgcgatcaagatgccctcgtcgtgcttgcggagccctcaggacccgcatgccataagggaagctacagctgtttttccacggaaaaagcagacgcgcaggatcgtttcggcatcttaaatgaactggaaagcgtgatcgccaaacggcaggcggagatgcctgacggagcctacacaacgtacctgtttcgggaaggcgtcgataaaatcctcaaaaaagtcggtgaggaagccgcagaggttattatcgccgcaaaaaaccgcgaccatgaagaattaaaatgggaagcggcggatttgctgtatcatttgctcgttcttctgcgtgagcagtcgcttcctttggatgacgtgcttgacgtccttgcgaaacgccattctgcatctgagtaaaacaaacctcgcggagagacccgtgaggtttttattctgtcaaacttaaacattcaataaaatattccttatttccgcaaccgtaggcagatgaatttgataatattgactaatagagtttattttggtttttatcaaaaatatacgttttgttcatattccgttcatgcacatccgttatagtataaacagtgatataggaggaaaacatatgccgaataaacaaccaaaaccaaaagggaaattcagctcattcttttcattagtcaaaaaaacaaaaccatcatacggtatgctggccttcgcgctgtctctcagtattgtgacaacgctcgtcagcctgctgattccgctgttgacaaagcagctcgttgacggcttttccgtgtcgtcgctgtcaggcgtgcaaatcggaatcatcgcagccgtgttcatcgtacaggccgcattaagcgcctacgccacctacgccctgaactacagcggccagaaaatcatctcgggactgcgtgatttgttgtggcagaaattaattaaactgcccgtctcttattttgacaaaaacgccacgggagaaacgatcagccgtgtcaccaatgacacaatggtggtaaaagagctgatcacaaacaatatcagcggatttattaccggaatcatttccgttatcgggtcactgacgatcttatttttcatgaactggaagctcacattgctcgtgctgatcgtcgtgccgctggctgcggtgattttagtgccgatcggccggaaaatgtttaaaatttctcgggaaacacaggatgaaacggcgagattcaccggattattaaaccacatcctcccggaaatcaggcttgtaaaagcgtcaaacgctgaagaagcggaatacggacgcggaaaagcaggcatcatggcgctctttaaactcgggctgcgtgaagcgaaggtgcagtcgctcgtaggcccgcttattacacttgtattaatggcggcgctggtcgctgtcatcgggtacggcgggatgcaggtgtcatccggtgaattgacagccggcgcactcgttgcctttatcctgtatttgtttcagatcattatgccgatgggccagatcacttcatttttcacacagcttcaaaaatccgtcggcgcaacggaacggatgattcatattcttgcagaaaaagaagaagatatccaaatcggaaaagccattgaaaacgcggatcagccgattaagctcgaacaagtctcattcggctacaaaacagatcaaaccatcttaaaagacattacggctacgattgaggccggcaaagtcaccgcgatcgtcggaccgagcggcggcgggaaaacaacgttatttaagctgcttgaacgattctacaacccgactgcgggcagcatcctgctcggaaatgaaccgattgatgcgtattcccttgagtcatggcgggagcatatcggctacgtgtcgcaagaaagcccgttaatgtcaggcaccatccgcgacaatatctgctacggattaaaacgcgaggtgactgatgaggaactgaggcaagcggctgacatggcctacgccctgcaatttattgaagacttaccgaagaaatttgaaacagaggtcggtgagcggggaattatgctgtcaggcggacagcgccagcgcatcgccattgccagagcgctccttcgcaacccgagcattctgatgcttgatgaagcgacatcaagtctggacagccaatctgaaaaatgggtgcagcaggcgctggaagttctaatggaaggccgcaccacgatcgtgatcgcccatcgtttatccacggttgtggatgcagatcagcttctctttgtcgaacagggtgaaatcaccggacggggcacacaccatgaattaatggcatcccattcgctgtaccgcgattttgcggagcagcagctgaagctgaatgccgacttagaaaacaaagctgtgtaaagcaagactttatgaatagaaagcagctgaaaaagctgctttttattttgcagccggagttctcttcatagaaagcgggggttaaattatgaaaaaacgcacaaagattttttattggcacgcggccttactgctcgtattcatgactgccgggtgtacggacggtaacgatgaagagccgagccattcttcaagtccggccggagaaagcagcggcatcaacaaggctgaaacagcatcagcggcagaaaaaaaagaaccagtaaacaaagattcacatcacatctctgcggacaaaagcctgtcggcagattattctcctctgcaaattgaatatgcccgcatctggctgcagcttggggaaaatcagcagatagatgaattgaacgttcgccgcattccggccggagcactcgtcaaccctgacgatcatacgagcgcccgctatcccgaagatgttacgcagttagcaggctcccggttagtcgatgggtcagtcacttacagcagcaatggtgacggcaccattcagatatacaatgttcctttgcgctgggagtctcgtgaagatactgatcaaggcgtaatgaaagaagtgacggaggaaatgatccgccatacaaaaaaagtgtctgtcgatacaggagacaatgaaaaaataagatggttaatagacatcatgtcgattcattaaaagaagacaggcaaaaaagcagaaggagggatttttatggctgtcatattggttgcggatgacgaccgccatatccgtgagcttgtccgactcatgatggagcagagcggctttgacgtcgcagaagcggaagacggggaagcggcggtgcggctgatcgaatcagcacctattgatctcatcatactggatgtgatgatgccgaaaatggacgggtttgaagtcagtgaagccgtccgcagctttacggacattccgattttgatgctgacggcaaaaggcgaaacgctggacaaagtgcaaggttttacttccggagcggatgattatctcgtcaaaccgtttgagccgcttgaactggaagcaagggtcaaagcattgctgaaacggtaccggatcaccgctgaaaaactgctgaccatcggaaatgtcacattagataagcaatcccgcaccgtaacgcgcggcggcggagcgggattgacgctgccccggcgtgaatttgagcttttatttaagctcgccggttatccgaataagacgttttcaagagaacaattaatagaagatatttggggctttgattatgaaggtgacgagcggacggttgatgtgcatgttaaaaggctgagggaacggtttccggaaaaggactatccgtttgctatccatacggtgcgggggctcgggtatcggtttgtggtgacagaatgaaacggatcttcagaacggctggaaaaatcatcatccttctcaccgtcaccgcattcttatggctggcggctcatctgatcgttcagggattcggtctcatatggccgattttgcttgtgccgtacgccgagcagattctgacgctctggcttgttttcggcctgctgtttataacgatgtttatcttttcaaagtcagcacgtgaaagacatcatgcgatctgggattcactgaccgccacgatcaagcaaatgtcgagcggcaacttcacagcggccgcctccaggaaaatggagaagattgaacgggaccaccccgtgacgaaattggctgatgaactgtcgacactcgccgcggaactgagtgaaatggaaaagctgaaacaagaatttatttcgaacgtttcccatgaaatccaaaccccgcttacttcattaaagggctacgcgcacctcctgaaaaaaccggatttatcatatgaggagcgggggcgctatttacacatcatcgagacagaaacagaacgattatcaaaaatcagtgaaaatctgctgaagctcactgcgcttgaacgccaaaccgaaccgatacaaaaaaaaccgttccgcattgacaaacagctgcggcgcaccatattgacctgtgagcctgaatggtccgccaaacagattgagtttctcattgatttacaggagtcgtatgtgtacggagatgaagcgctgctcagccaagtatggatgaatctgattcacaatgccgtgaaatttaccggtgaaggcggccgcatttccgttaaaattgttgatctgccgggagcggcggctgtcgaaatcgccgacgacggaatcggaatggagcctgaacaggcggagcgggtatttgaacggttttataaagcggataaggcgagaaacgcagggggaagcgggctcggcctgtccatcgcccaaaaaatcgcagagctgcacggcggttcgatagaggttgagagcaagcgcggcgaaggaacccttttccgcgtcattcttccagccgagcctcgtgaaaaaaacagctaaaatctggtcgaaccagccagtaaaaaacgaagccgatcctgtcttttgaactattgaggcgaaaccgttttatggtatactactgacggtaatacgtataaaacggaggatatttgtgggaaaacacacttctgaacagaaaaagcacgcgcaaattgtccagctgcttcaggatggacaatatttttttcataaaggcttaaaagcatataaagagcggaatttaaaacgggccagcaaactgattcagcgggccgtccatctcgagccgaatgattccgaaatgctgtcacggctggccgtcatttattctgaaatgggccactaccagcagtcaaatgagctgttcgactttattttggtgaacctgaaagaagaaatgcccgagtgtcattattttaaagcgaataatttcgcgcatttggggctctttcaggaagcatacaaagaagcggaggcttattcagatgccgatccggacggggaattcagcgaagagattgaaaatctgatggagcttttggatttcggcgaagcgggtgaaaacgaatcgctctatgaccaggatgagctgctgatcaggcaggaccgggcaaaaacgcttcttgagagcggccagcttcatgaagcggttgtcatgcttgaagagattacggccgattaccccgagctttggtctgcatacaacaacctggcgctcgcttacttttactcaggcaatgttacaaaagcgaaacagacggtattcgaagtgcttgagaaaaatgaaggcaatctccatgccctgtgcaacctccttgtattctgctattacgagagggaagatgaaaaagtcggagaattgagcggaaaactcgccaacgtgtatccgattttattcgaacagcgctataagctgggggcgacgcttgcgcttgtcggcagacatgatctcggttataaatggctccgttctctttacaaaagcgggttcgaaggcgacgaaacgttttattactggcttgccgcctcagcctacgggacaggccgcacagaatttgcggaaaccatttggaaaaaggccgaagccgaatttcccgaatcagaccggcccgcgccttgggcggagcggcaggaaccgctgcctgcttcacttgaacagcggcttgccgcctattatatcagcagcgctgaaggagagcggaaccagcttgaaaaagttctgacggcaaaacgcgccgtttcaccgtttgaacaagatttcgtcagactgctgctttccggtgaaaaaggcgcttcaggcgtctccggtgacgcgctgttcacgtatcggacggtcaagcttctggagaaagcggaagccgacagtttaaaaactgacgtcatgagctgctgggtttttcacgtcattcagcacatccgcgccgccgctgccgtacagaatgagcgggcatgggccgcagccatcgcatacgtatggaaagaagcaaacggcgaaaaaacgacgaaaaaagaaacggccgccgtttacggtataaccccggcaaccctttcgaaatacatcagacaaatagatgatatattagaataaaaccgattctttctatataaagagtcggttcttttttttattataaaggggcaaaacagaactttaccgccgaaaaaagaggtattcatacgtatttttttgctttttgaatcgaaatcaggccgtaatcaccgtttattttgcaaaatatgagatttgcaatcacattgaaatataactgtaataaaaattgtcgaaacatgatggtataatgagtctcgtacataagagattagtttattttacatgtgctgtataatctataccaattaaccagattcaaagaatcgtacataaaaatcatcagcctcacgggcatgtgagggagcgtaactttgatgttcataatagaattccaaatgagaacaggtttaaagtaaaagggaggaaagaaaaagtgaaaaagagtttattaacacttggtttggcttccgtcatcgggacaagcagttttttgatcccgtttacaaaaactgcatcggcggaaacattagacagcaaaaaagcgaaaattgaaagcaagcaatctgaggtggcttcaagccttgaagcaaaagaaagagaattgtccaagcttcaggacaagcaggctaagattgaaaaagaactgaaagacattaacgctaaagcgttggatacaagcaataaaatcgaagataaaaaagctgaaaacgaaaaaacgaaaaagcagatcgctgatttgaaaaaagaaatcaaagaaacagaagcgcgtattgaaaaacgcaatgaaatcctgaaaaaacgcgttcgttctttacaggaaaacggcggttctcaaggatacatagatgtacttttaggggcgacaagcttcggagacttcatttcccgtgcgactgcagtatcttctatcgttgatgcggataaagacctgatcaaacagcaggagcaggataaagcgaaactcgaagacgcagaggctgaacttaacgtgaagctgaaaaaagttcaagatgatcttgcgaaactcgagtctatgcaaaaagacctgaacaaacagcttgatcagaaagacaagcttttcgacgaagcgaaaaacggtcagaaaaaagcggcttccgctatctctgatctgaaaaaagaagcgtcacagcttgcaaaccaaaaagctgacactgaaaaagagcagaagcgcattaaagctgagcaggctgcagcggctgccctgatcaaaaaacaggaagaagcgcaaaaagcttctgaagaccaaaaccaaaaagatgacagccagccggcaccggcggttaaaactgtgaaaaaagcggctgtttcaacatcatctgattcatctgacagctcaagcaaaccgaagagcacttcaggcggatcatctcataacagcggcggttcagatgattctgacggcggatctgttatttcaaattcaggcggtattgaaggcgcgatcagcgtaggatcaagccttgtgggtcaatctccgtataaattcggcggcggacgcactcaatccgatattgacaaccgtatctttgactgctcttcattcgtacgctgggcttatgctaacgcaggcgttaatctcggacctgcaagcggcacaaacacagatacattaatcggaagaggtaaagcagtaagcgcgtctgacatgaaacgcggagacttagtattcttcaacacgtataaaacaaacggccacgtcggcatctacttaggtaacggaacgttcctgaacgataatacatcacacggtgtatccattgattctatgagcaacccttactggaagaaagcattcaacggcaatgtaagacgtgtcgtgcaataatgaataagacaagggccttctatcccggaaggctctttctttatttgtatacccgctcaggagctccctaatcacggtttctcagaaaaatgagcaaaaaaatagcgaattgccctcagatttaataggatatgggtaaggaatacgattgatggggattcttagtcatatagggtgcgccccatttcgaaaaggagtgaatcatggtgtcagaagaaaaaatttatgatgtgatcattatcggcgcgggtccggcggggatgaccgctgctgtttacacatcacgagcgaacttatccacattaatgatcgaaagaggaattccgggcggccagatggccaacacggaggatgttgaaaactatccgggttttgaaagcattctcggccctgaactttctaataaaatgtttgaacatgcgaaaaaattcggtgcggaatatgcgtacggcgatattaaagaaatcgtggacggtaaagaatataaaacggtcaaagccggttcaaaagaatataaagcgcgcgccatcgtcatttctgccggagcggaatacaaaaagatcggcgttcccggcgaaaaagaactgggcggccgcggcgtatcgtactgcgcggtttgtgacggcgcgttctttaaaaataaagagcttgtcgttgtcggcggcggagactccgccgttgaagaaggcgtctatctgacacgcttcgcttcaaaagtcaccatcgttcacagacgtgacaaattgcgtgcgcaaagcattcttcaggcgcgtgcctttgacaatgagaaaattgacttcaaatggaacaaaaccgtaaaagaaatccatgaggaaaacggaaaagtcggcagacttactcttgtggataccgtgacgggagaagaggaagaattcaaagctgacggcgtctttatttatatcggtatgcttccgctttctaaaccgttcgaaaacttgggcatcacaaatgaagaaggctacattgaaacaaatgcccaaatggagacaaaagtcccaggcattttcgccgcgggagacatccgtgaaaaaacgctccgccagatcgtaacggcgacaggcgacggaagtattgcggctcaaagcgttcagcattatgtggaagagcttgaggaaacgctcaaaaccgttaaataatcactgtaatgttcagtttttgaatcgttactgtgttttaattacgctgtaacacgggtgaaatactgatgttttaagatgaatgtagtaattgaccccctttttaatgaatacactttggcacggattccagtatccgtgccctttttttgcgattttttgttttctgtcaaataaaagaaaaggatgtcggtgtctctgcattgtgagagacatgccgaaacggtataatgaagagacgatgatttgttgagaaggttaggtgacgtacttgtgcaaagagtgacaaattgtgtgctgcagacagatgatcaggttctccttctccaaaagccgagacggggctggtgggtcgcgcccggcgggaagatggaaagcggcgaatccgtcagagattccgtcatcagagagtacagagaagagacgggcatttatatactaaatccgcagttaaaaggcgtgtttacctttattattaaggaacaggaacaaatcgtgtcagagtggatgatgtttactttcgtcgccgactcctacacggggcggaatgtcgctgaatcagaggaaggcgttctgaagtggcatgacgtaaaagatatccacagccttccgatggcccccggagacgggcatatccttgattttatgatcaagggccaagggcttttgcacggcacctttacgtatacgccggacttcgagctgctcagctatcgtttagatccgcagcttatcaaataaaagaaagaccgcaggggggagaaagatgagtatgaatgaaaaccatgatattcagctcgtcatcattacgggaatgtctggagcggggaaaaccgtcgccattcaaagctttgaggatctcggctatttttgcgtcgacaatctgccgccttccttgctgccgaaatttttggagctgatgaaagaatcaagttcaaaaatgagcaaggtcgcgcttgtcatggatctgcggggacgtgaattttttgacaggctgattgaggcgctggatgaaatggcggaaaatccgtggattacaccgcgcattctctttttagacgctaaggattccatccttgtgacgagatacaaagaaacgaggcgttctcacccgctggccgctaccgggcttcctcttgaaggaatcgcgctggaacgccagctgcttgaagaattgaaagggcgctctcagctgatctatgacacatcggatatgaaaccgcgtgatctgcgtgaaaaaatcgtggcgcatttcgccacgaaccaaggtgaaacatttacagtgaacgtgatgtcattcggtttcaaatacgggcttccgatagatgccgacctcgtgtttgatgtaaggtttctgccgaatccattctacattgaaagcatgaggccgcttacggggaaagatgaggaagtgtcatcctatgtgatgaagtggaacgaaacacaaaagtttattgaaaagcttgttgatctgctcggctttatgcttccgtcttataagcgggaaggtaaaagccagcttgtcatcgcgatcggctgtacgggcggccagcaccgctccgtcacgctcgctgagtatttggctgactattttaaaaaagatttctatactcatgtcactcaccgggacattgaaaagagaagccggaaatgaataagaagccgaaaatcgcaatcttcggcggcggaacgggtctgtccgtgctgcttcgggggttaaagcataagcccgttgatattacggcgattgtgacagttgctgatgacggcggaagttcaggccgtctgcgggatgaacttcaaattccgccgccgggtgacatccgtaacgtactggctgctttgtcagatgttgagccgctcgttgaaaatctgtttcagcaccgtttcaacaaaggaagcgacttaaccggacattcgctcggcaatttgattttggcagcgatgacaaatataaccggtgatttctttcacgctgtcaccgaaatgagcaaggtgctgaatgtccgcggcagagtgctgccggctgccaacaccagtgtcgttcttcacgctgaaatggaggacgggcaggtcgtctccggagaatcgacaatcccttcttacggccagcgaattaaacgggtgtttcttacgcctgaaaaaattgatccgctgccggaaacgattgacgtcatccgtcaggccgatttaatcattatcggtccgggaagcctgtacacaagcattcttccgaatctgctcgtgccgaaaatcggagaggaagtcgtcaaggccgcggccaaaaaagtatatatatgcaacgtcatgacacagcccggcgagacgcttcaatacagcgcggccgaccatgtcaaggcgctgaacgatcatatggagcagccgtttatcgacacgatcttaatcaacaatgaggagatccctgacgaaatcaaaagcaaatatgcgaaagagctggcccggcccgtcgacttcaatgttgaaaagctgaaatccatggggcttgaggtcatcagggatcagattatcacgtataaaaatggcgtaatccgtcacgatacacataaagtggcttctcttcttgtcgatttattaagggactagaggccttttgaaatgaggtggctaatatgtcatttgcatcggaaacaaaaaaagaactgacgaatctggaagtgaaggactgctgcgccaaggcggagctgtccgcgctgattcggatgaacggttccctgtcattttcaaaccgccatctcgtgcttgacgttcaaaccgaaaatgcggcgattgcccgccgcatttatacattgctgaagaaacaatatgatgtatcggtcgaactgttagtcagaaaaaaaatgcggctgaaaaaaaataatgtttatattgtgcgcttttctgaaaatgcaaagctgattttagaggaattgaaaatcctcggggagaactttgtatttgaacggaatatttctgaggaactggtggcgaaacggtgctgcaaacgttcttatatgagaggggcgtttttggcgggaggatctgtgaataatcccgaaacatcgtcgtaccacttggaaatcttctcgctttataaggaacataacgattcattatgcgccctgctgaatgattttcatctgaacagcaaaacgcttgaacggaaaaaaggctatattacgtatttaaaagaggcggaaaaaatcactgaatttctgaatgtcatcggcgctcacaattcactgctgcgctttgaagatgtgcggattgtcagagatatgagaaactcagtgaaccgcctcgtcaattgtgaaacagcaaacttaaacaaaaccatcggggcttctctcagacaggtggaaaatattaaatacattgatgaacggatcggtcttgaagcgctgccggaaaagcttcgcgaaattgcgcagctgcggattgattatcaggaggtcacgctgaaagaactgggggaaatggttgcaagcgggaaaatcagcaaatccggcatcaatcacaggctgagaaagctcgatgaaatcgcagaacagctgcgtacaggacaaagcatcactttgaaataaccgtacagaaaaggggagatcttatggttcaggggaaagtggaagtgcgtttaaagacgggattgcaggcgcgccccgctgcattgtttgtacaggaggcaaatcgttttgcatcagatgtgtttcttgagaaaaacggcaagaaagtgaatgccaaaagcattatgggattaatgagtctggcggtcagtacggggacggaagtcactctgatcgctgaaggcgacgatgaaaaggaagcgctggaaaagttgtccgcttatgtgcaggaagaagtgtaaacactttgtaagggggacggaacgatgaatgagtttctgaaagattgttatcaaacgataggctgggaaaaggattccctcgatttcagcaacctgccggagtttttaaaggcgctcgcgtatcggtttccgtttgaaaaccgcgccgttttgtccaaaaaagaatatgacgtcacgaaagaaggactgtggcggcacatggtgaaggaacctcacggcggtctttgttatgacttgaacggactgctttatttcatcctgaaagatgccggatttgatgtcaaattgatccgcggaacggtctggaaaaacggctgggcgctgcccggcacacatgcggccgtacttctttccgccgggggaaatgagtacatcgctgatgcaggcttcggcctcaatctcgccatgcagcctgtgccgatgtcgggagacgagacggtatcagcggccggagcgttccgcgtgaggatagaagagacggaattcgggacatacgtgcttgaaatgaacaaaggggacggctggcagacaggctacgcattttcgcttgaagaaatcgatgaaaaggacctcaagtctatgaaacaaacaatctttgaacatgaacgttctcctttcaacaaacgcctgcttgcttctaagcggacaccggaagggcacatggttctgtctgaacgcaatataacaataaaaaaacacgatggcacggcggaaaacagcagaatagaccgctcagagtttgaagaaaaatttactgctcattttatatgaagcttgcagattctctgcaaaaaaacggcctccgcagggaagccgttttttgtatgtgtttatctcatttttgtaaaggtttgatagtggtctgtcgtcttataaatcagccagtcgcttgagtaaagaatccggtctgaatttctgaagcctgatgtatagttaatatccgcttcacgccacgtccgtccgctttttacagggagtttgccttccctgtttgagaagatgtccccgccgatgcttttccccggggcgacgtccgccagattcccctttgatgccacccagccgagggcctgtgcttctgattttgtaatgtagttatcaggaagcttgtgataggtctgaagataatccgcaaccccgtcaaacgtgttgataacctgtgcttcagtgtgcgccttgtgagaagatgtatccgtcttggcagccgttgaaaacagcatccccgccgcggagaacagcaccagcaaacaaacggaaatccacgataatcgttttttcaaagcaatacctcccatttttatcatgtgaagctgattccttttcattgtatcagcatcaagagaaaggaatagaaagaattttaaaatagtacttttgatctagcgaaaaataaaccccggctgaaacggccgggatttttcatctcattgaaattccttcgtgaggtttttcggtgtttttccgtatacggcgtcaatcatgttctgtgcggcttgcttgaacatattcaagcggatttttgcggttgctgacccgatatgcggaagcaatgtgacgttttccagctgcaggagcggattatcttcggcgatcggctctttttcaaacacatctaaaccggcgccttttatccagccctcttgcaatgcgcggatgagcgctttctcatcaactgtctttccccgggaaatattgacgaaacatgccgtatctttcatcaatttaaattccctctctcccatcatatgatatgtttcgtcagtaagcggggtaattaaaagcacaaagtctgatgttttcagcagtgtatctaagtcggtatatgtaaccccgagttccttctcggcatccggttttctgctgcggttataatacagcacgtccatatcgaagccgaattttgcccgtttggcagcttgttcaccgattctgcccatgccgataattcctaatgtctgatggtggacatccataccgaaaagagattcctcctcaacggttccccatttgccggcgcggacgaatcgatccaattcggcaacccgtctggcggaagacagaattaatgaaaaagccagatcagcgacagtgtcatctaaggtgtacggtgtatgcgtgccgacaaccccgcgccttttcatttctttaatattaaaattatcatagccgactgaattattgctgacgaccttcagcttcggcgcgtgatccagcaaatcactgtcaatcgccgttccggatgtcagcagcccttcagcatctttcattttttcgtacagtttctcttttggaatggtatcttctttccagatgtcatagcggcaatgctcgtctatcatttgttcgacttcgggcggtatcggtttcgcgatgaatacatagggtttcaacgggcttctcctcctttgtctttcttctctattttattatataagagaagcggtaacgtgagaaataatcaaacgcattacgataaatttctggttcttttgaacttaaaatgaaagaaaaaggaatgtacatgcttgatttctccaaacaataacagaatccgcctatatttctgaaggcaaaatgagcggaaccgctgttttcaaaagctttataggttggtgtaaagataaattttattatttttgaaagatataaatgaatataatctgaatttacagtcaaattatcgtgtctttttttgaaagcgcttttgaggcctttttctgtgctataattccttactgtaagctgggtaagaaggcttgcaatacaatcggatgggagatgaatagaaaaatggtttctttatcaagcattttggagcacaaccagcagtttgtccaagaaaggaaatatgaaccttaccaaacgacaaaattcccgaaaaaaaagcttgtcatcgtatcctgtatggatacaaggctgacggagcttctgccgcaggcgatgggactcagaaacggcgatgccaaaatcataaaaaacgcgggagccattgtttctcacccatttggaagtgtcatgcggagcattttggttgccgtttatgaactgcaggcagaggaagtctgcatcataggtcaccgcgagtgcggaatgtcgggattaaatgcggcttccatattaaataaagcaaaagagcgcggggtggaggacaaatgtctcagccttctgcagcatgcgggagtcgatttggaaacatggctgaccggttttcacagcgtcgaagaaagcgtggcccacagcgtgaatatggtcaggcatcatccgctcttgcctgaagaggtgccggtgcacgggctggtgatcgatccgggaacggggacgctggatgtagtcgttgacggttatgaaacagtcaaaggaggatgcagctgacgatgcaatttaccggcagatatcagggatacaatttgcagaaatttcagaaagacctaatcgcgggaattgtggtcggaattgtagcgattccactggggatggcctttgccatcgcctcgggggtcggtccggaatacgggctttacaccgttattgtggccggaattctgatttcgctgttgggcggctctaaatatcagatcggcgggcctacaggggcgtttgttcccattttatttgccattgtgatgcagtatggttttgagaatttacttgtagccggttttatggcaggcgtcatgctcgtcctgtttggcgtatttaagctcggaaagattatgaaattcgtgccgaagccggtgatcgtcggatttacggccgggatcgcggtgctgattttctcggagcagattgcccattttctcggtctgcgcgatatccaaaagcatgaaagctttatcctcaacattgcggaaataggcaagaagatcggaacctttaatttgtacagcatcctcatcgcgggaattgctttggccattttgctgttatcagccaggctgatgccgaagattcccggcgcgcttgtggccctgcttgtctctacagccgctgcggtcgtgttttttcctgacaaaatggcgacaatcggttctgcttacggagaaattccgcggcagcttccggctttccagcttccggatttctcaattgataacatggtgatgatgtttccctcggctctgatcattgcgcttctcggcggacttgaatccatattatcggcgatggtcgcggacaatatgaaaggatcacggcatgacagcaatagggagcttgtcgggcagggcatcgccaatatggcagcgccgcttttcggcggcataccggcaacgggagcgattgcgcggaccgcaacaaatattaaaaacggcgcagtttctccgatttccggtgttgtccacggagtcaccgtcctcctcgtcctgctcgtcttcgccccgcttgccgttcacgtaccgctggcaagcatggcgccggtattgatggttgtggcttggaacatgagtgagcggagggaagtcgccaatatgatgcggctgaaaaacactgattcattcgtactggcggcaacctttttgctgacggttctgtttgatttaattatcggcgtttctgccggtcttgtgctcgcttttgttttctttatcagaaaaatgagcgaatcaacaagcattaaaacaccgcatgccgcggtcaaatcggttaaaaatgattcgtccgtcagcacatattccattgaagggccgctgtttttcggttcaattgattcactggaatcatcgctgctggagaggcttcaggaaaagccgaagacgcttattctgctgatgaataatgtgcattacatggatacctccgcagaagcggtgctggggaatgtgatgaaccggatcaaacggcataacgggagattgatgatcgtcggattgcaatcacagccgagagagctgatccggaagacggggctgtttcataaaatcgggaaacagcatttctttgagcatcaggacgagataacgggataaattcagatacggcctgtccatgaaaaagcggacgggccgtgtttttattcggtttcaaagcgcttgatcagtttttcctgatgggctttcatcgcatcttctaacgtgattccgtacttatcggcaaggatagccagatttccgaggacgtcacccatttcttcaatcagctcctgcctgcgttcagcctgggttgcgtccttttcatccggccggtctctgccgatttcatatgctcttaccgcccgggcgagctcacccgcttcttccattaaaaagccgattctgataaatggcccgtacgccgtccatcctcgtttttcgtaaaaatctttcgtccattgttctgcttcagccatctgcatgtgaaacactccttatgtcctgtatgattcttattgatattatcatatagagatgggacaatatatagtgtattttgatttattgatgtacatatatagatgcggagatgaaaaaatgaaaaccatttgtgtatttgcggggtcaaacccgggggtaaatgaagagtacaaacgcaaagcggccgaactgggtgaatatatggcggagcagggaatcggccttgtttacggcggttcacgggtcggtctgatgggaaccgtcgctgatgcgttaatggcaggcggcggaaaagctgtcggcgtcatgccgagcgggcttttcagcggagagattgttcatcagaatctgacggagctgattgaagtcagcggcatgcatgagcggaaagcgaaaatgagtgaacttgccgacgggtacattgccatgcccggcggtttcggaacatatgaagagttatttgaagtgctgtgctgggcgcaaatcggcattcatcaaaaaccgatcggactgtacaatgtgaacgggtattttgagccgatgatgaagatggtcaagtacagcatccaggaaggattttcgaatgagtctcatttaaagctgatacatagttcctcccggccggatgagctgattgagcagatgaatcggtatacatacccgattttagataagaaatggcgtgaattgtaaggcagcggtctgaaatatgtttcggcggctgcatctaattcattctgacggaaagttcttttctccttctcatgcgtaccacgcctttcttcgtaataagagatatgtctgagaataagaggcgaatgagactgctgttggggttgaaagaagaacatccatttcctcagaggagatggatgttttgcggtttccagactgtatgcgtttacaacttttgttgcacgaaagtttcttccgatatgaaatcatcctgctgcatcttttgtttttttgaaccgattccaaatataccgactgtcagtgcacaaagaaaccagcagcctgtaaagaataagaaaacacttaaaaatccgtagcctgaatacaggaaactgacgacaaagggaccggctacatttgcaaggcgtcctacgccgtaagtgaggccatttccagatgccctggcttcaaccggatataattccggcgtataagcatatgcgatcgaactgaaagtacgctcaaacatatgcatgagaaatccgcatacgataatgaccatcggcaaaggattgatgccgtaaaagaatccaagcgccataataattaacgataaaacagaaatggcccactttcgatccacacggtcagagatttgcgccgcaatgagagcgcccagcggggcaccgatcgttcccagagtgacgtatacgatagactcatccattgatacgccttctttcaccagaagggtgggaacccacgtgccaaagccttgaattgcaatggtggaagctgcccacatcgtcattaaaacaaaagttcttcctgctaaaggcttttgaaacagcgtccgatatggaacggattttacagcggtttgtctgctttgcagagccggagctggttcaggcagttcacccttttcattttctgcttttgcctccagttcaagcagaatgcggtgtgcttgttcgctttttcctttcgtgtccagccatttcggtgattcttccagttttctggcgatcagcggaaaaaaaataccgaccgcgccgaatagaaagacaaaccgccagccgtaagaggcggacggcacgaccaatttagccacccagccggccgcaggaattccgcatatgccgattgtaatacagattgcctggtatttgcctttagttgcggatgggaaaaattcgctgatatacgtactcgccacaatcgttgtggcgccgatacctaaactcgtaaaaaatctaaaaacaccgagtatttctgggttccaagccagagaagagaggagggagaaggaagagaaaaaggtgacaaccagaattaaaccttttttccttccgaaacggtctgaaaaccatcctccggcagaggcgccgataaacattccgaaataggagacagatgtaataaaagcgatagtatgagtggatatgttccattcctttaaaagtgaaggcgccgcatatgaaaacgtatttaaatcgataaaatcaaaaaagtaagcgaatgaaaggataacgagcactgcttgatgggcccttgaaaaaggcagtctgtttaatcgattagacgcatttacattgatcatctcgtattcctccgtttatctttgacttgtctgaagacggtattaaccaatgtgattgagcgtattcatgctgtaactttgtttagtaaacacatagccttcagagatttttcttgctgtgcgtactactttaatcgttgttccatccggatcaacatctgcctcggtttttaaaataccgcttggatgccccaatcggatcgttctcccggagaatgaaaattcagataatattgtatcttgcaatagcatgccggcagtcgtacataccgcccctgtaatggctaaagcttgatgcggtttttgcatggacatcatacgaatgacaagatccatctcttctgcgtgtctctttatcccttttgtatcgatataatccgctggagatgagattaatgtcagttttggtacggccggtgattttgcagcagcctcatgtctcggagcgaatctgcatttctcggctgcaatcgatcggatcatttcgagcttttccaatatatccggggtatattcatccggaagttctaagccggtaagccccgtgtcctctgcttttacaaagacaagcggattggcgtaatcaataatcgataccgagatatttccatacggggtatcgagaacatcaataggctgaccggtgggaaacagcttaccggtcaccgctccttcagcctggtgaaatgaaagataaataggagaagctgtacctggaacccccggaatagagcagtccccctggtaatgaaatgttccatttctgacttcgacttctgctgcgatcactttttgagtgtttgtatttaaaattctgacttttgtaaccggctcttcagcttgaacgagccctttctcaatagcataagggcctacggcagaagagatatttccgcaattgcctttgaagtcggtaaatttgtcagtcagactgacctgagcaaacgtatactcaacatctgcatcctttctggcggatttcttaataatggctgccttgcttgtgagagaatggccgccgccgagaccgtcaatttgtctctcgtcagggctccccataatgtctaaaagaaaatcgctccataggtttgtatcgtctggcatgtctttttgaagaataaaaacgcctttgctggtgccgcctctcataacggttacaggaactttttccatgctgtctcatccttacatcattttgtgtggataaaaaggtaccggtccctttggaagatatcgtatgataaataaggattataagtaaaacatataatttttataaagttaaataaaaaacttttataataggagaaaattttatagcagaaaaatattttgggggatttcatatggatgaaaaggattggattgtgctcattacattattcgaagaaaaaaatatgacgaaggcggcagagcgattatatatgacacagccggcgttaagttatcggctcaaaaacctggaagcacaattcggagtgcgccttttttataaaagaaaaaaagggatggagttcacttcagaaggtgaacatctggttgattattcgaaagagatgctgcaggagttcagaagagtgaaggatgatatgctcaatatgagccatgaagtcagcggggttctcagattaggagtctcaagcaattttgctcagtataagctcccggcgattctaaaacggttttctgatcagtatccgtctgttcaattccacgtcaatacgggatggagtgcgaaggtgatggatctgcttcatcattcgggggtacaccttgggattatgagggggaattatgattggcaaggagaaaaacaactgctgaatgaagagaggctgtaccttatttcaaaaactgaaatcaacagtgaggaccttcccaaattgccgatgatttattatcaaactgatgcttctttgaaaagtttgattcaaaaatggtggaataaccaatttactgaaccgcctttcattgcaatggaggtagacaggcaggaaacctgtaaagagatggtgaaaaacggcctcggttattctgttgtgccggaaatctgtcttcagccttctgatgaattatacacattggcgctatcctataaaaataatgaacctgtgatacgcgatacttggctcatgtatgattcttcagcgttagaattatctgtcgtcaaagcattcattacttttttgaatgggaataaagcataaaaaaacctgcaagagacatcatctcttgcaggttttttgggcattacttctggtcttccgtattgcgtgtcagcactttatcgattaagccgtattctaaagcttcatcagctgatttgaagttgtcgcggtctgtatcgcgctcaatgacttcaagcggctggccggtacgttcagcaagcactttgtttaatttgtcgcgaagcaagagaatgcgttttgcggcgatttcaatttctgtcgcctgtccttgcgctccgccaagcggctggtgaatcataacttcactgttaggaagcgcgtaacgtttgcctttttctccggctgcaagtaaaaatgctcccatagaagcggccataccgatgcagatcgtggatactttcggtttaatgaactgcattgtatcatagattgccataccggcagtgattgatccgccagggctgttaatgtaaatggaaatatctttttcagggtcttccgcttcaaggaataaaagctgtgacacgatggagttcgcaacgttgtcatcaatcgcagatccaagcatgataatacggtccttcaaaagacgggagtaaatgtcataagctctttctccgcggttcgtttgttcaatgactgtaggtattaaattcataatgctcctccttcaccttttaggtaagtatgtatttacatgatacatttttggtcaataaaggtcaaacaaaacgctgaccaaaatgccaaccttttcttctaacaccatttttcccataaaacaaaaagttcaaacagcaaagtgaaaatgaggatgatcagcgccggagccttgagaaaatgatatggccggagcgctcaaaatagaccgcagtcgcgtcggtacatacggctgaacggtctgactacgttgtccgtccttccaaaagccgtaccggcaaatacgtttccagcggcaaatcatcaaattcgccttcaatttcttttgctaaaatctcgatggctgttttggaaatcaattcgatcggctgctggatggttgtcaagtccggcagaaccgattgaacggtttcagtgccgtcataaccgatcacttttaattgattcgggaggtctttcccccgttttttagcctcggtcatcacggcagccgccatgatatcatcgctggcaaaaattccgtcggtgtcaggctgttcatcgaataatgttgaaataatatcatggtaatgctgataaaagggtacttcatatgtaataggcttccgtccgtgttcatgcatgacgtcttcgtatgcttttcttctgaggtttgccggtgtttcgagttcaatcgggccgttgagatggacgatgtgccggcaccctttttcaatcagcagttcagccgccttttttccgccgtcatagttgtctgagccgacgacgggaatcgtgtccgataagtaatgatcaatggcgacaatcggcagattctgcttgtgataattgagaattccccggttataagtcacggcgatcacgccgtccacttggtttcttatcagcatctccaaatatttttcttccttatcctttcgatgtaaactgttgcaaagcagcagtttgtagcccatggacgtacaaatgctttcaatatgaaaggcgagttcgccgaaaaacgggttgctggagtttgggatgataagtcctattaaattggttcgttttcggaataaagagcgggccagatcgtttggaaagtaattgatttcttccatcgccttgtacactttttcttttgttttttcgctgatatagccgcggttatttaatacccgcgaaacggttgtagatgaaactcccgctattttcgcaacatcatgaatgttaggcttcattcccgtgccctcctgcatactgaaatggcttacaatttccgtcacgcacttattttagagaatcaggctgacatgtgcaaggacattccatgtttctgttttcatataaagagggtgcgttttgtttgattggaataatcagaaaatcatatgtcaaccgattgacatatgaaaccggttgacatacaattctttttgaaagcgctttatttacggagtgaagggaagtgacgggtatggagagatggctggcggcaataaagtgaaagaatcaagcagcggcggaaagtaagcgcttactcggagctcgcatgtatgtgatgaatatgaagaaggaagtatgcggctcaaaatgactattaaaaggtcctattaaaggagcggtgcaaatgaaaagctcaaaaagtctgtattggaaactgagtgcttatttcttctttttcttttttacttggtcttccagctattctttatttgcgatttggttagggcaggaaatcaatttaaacggatcagcgacaggcattatcttttctgtaaacgccgtatttgccctgtgcatgcagcctctttacggttttatctctgacaaattggggctgaagaaaaagatattgtttatgatcagctgtcttctcatattcacgggtccgttttatatctacgtctatgggccgcttttacaatacaacgtctttcttggcgccgttgtcggaggcttatatttgggagccgcttttttggcgggaataggcgcgattgaaacgtacattgaaaaggtcagccgtaagtatgatttcgagtatggaaaatcaagaatgtggggctcgctgggctgggcggcggctgcattttttgcagggcagcttttcaatatcaatcccaatatcaacttctggatcgcgtctgtttcagccgtcatattaacggccattatcatgtccgtgaaaatagaaatgaccgatcatgagaaaaacagagcggaatcggtccggttaaaagatgtggggcggctctttttattaaaagatttctggttttttatgatgtacattatcggggtgacttgcatttacggcgtttatgatcagcagttcccgatctactatgcgtctttgtttccttcagtgtcgatgggtaaccaagtattcggctatctgaattcattccaggtgtttttggaggccggcatgatgtttcttgcgccttttatcgtcaataagttcggagcgaaaaacagtttgattttagcggggtttttaatggctttccgcatcgtcgggtccggaattgcagttgagcctgtaggcatttcatcaatgaaactcatccacgcactggaattgccgattatgctgatcgccgtttttaaatatttggccgccaattttgatacgcgtctgtcgtccgtcctttatctcgtcggttttcaattcgcatctcaggcaggcgcgtcgattctgtcgccgcttgcgggaggattatatgacagtgcggggttccgtcaaacctatctcatcatgggattcgtcgtctttggttttaccgtcatctccatatttactttattgggcccgaaacaaaacagcaggcgtgtccagcgtctgcaaaaaatcggatagagaggatgttacaaatggacagaattcagcaggcggaagaagctttgaaggaagccgagggtaaagtgaaacaaagatatcgattggggtatcatattatgccgcgggcgaattggatcaatgatccgaacgggcttattcagtttaaaggagaataccacgtcttttttcagcatcatccgtatgatgagcattgggggccgatgcattggggacatgtaaaaagtaaagatctcattcattgggagcacctgccggttgccttagctccgggggacgaattcgatcaaagcggctgtttttcgggaagcgcggtcgatgatcatggaagattagcccttatctatacaggacataatataattgatcaagagaaagacctattctatcagactcaaaatatcgctgtcagccaagatggaaccgtgtttgaaaagcttcaggaaaaccctgttattacggaaccgccggaagacagcgcccgtcatttccgcgatccgaaagtatggaagcatcgcgatgtttggtatatggtcatcggcaactcttcaaaagaaaacgtcggacgggtcgttttataccgttcacctgatttgcgtgattgggaatacgcgggggttctcgcccaaagtgacggtaatctcggttatatgtgggaatgtcctgatttctttgaattaggcggcaaacatgtcctgctgatttcgccccagggtatcgaggcggacggcgattcatataacaatttacatcaaaccggctatttaatcggtgactataataatgaaacaaacaaatttacacacggcgcttttaaagaactggatcacggccatgacttttacgccgtgcaaacattattagatgataaaggacgcagaattgccatcggctggatggatatgtgggaatctgagatgccgacaaaagcggacggatggtgcggtgcactgactttgccgcgggaactgactttgcgtgatgatcataaacttttgatgaatcccgtggaagaaaccaagcagctgcggaaaatggaatatcgggaatgtgccggacgatcggtttcagggagttacttggcaaagacgcccgaagacctgcttgaagtccgagccgtgtttgatgtaaacgattctgatgccgaaacggcaggttttaagattcgcggccttgacgaagaagaacttgtgctgacatacaatctaacggataaaaagctgacacttgattgcaccaagatggggaaagacggtgtgagaagggtgcggctggatgcaaacggcaagctggcgctgcgtatctttattgacagatcctcgattgaagtattcgccaatcatggagaaacaacgatgacaagccgtatctatccgaatgaaggcagattggggattgagctgttttctgagaaaggcgccgtaaaggttgaggaattcacctattggacgttaaaggacatttggaaaaaaagctgaaacgggtgattatcgctttttctgaagcggctggaaatgtaccgagccgagggcagtccgcctgaaatacattttttgtgaaaatcaatgccgttaaacgatgcaggattatgcagcgtcctcgtgcagcataatcctgttgtgtataatcaaaaaagagttgctttctgtgcgtttctttattataatataaaggtatctgattgaaaaaacgtgcgctcgtagctcagttggatagagcggtggtttccggtaccacgtctgtcgggggttcgaatccctccgagcgcgtctcagttaagacgataggaaaaacctcgcagatgataaatctgcgaggtttttattttatcttgttttgaaactgttaatgaatgtgtctctgttatgttcggtgccggcaatcagccgcgcactttcactgatccgctgcgcaagagctttttgcgccttgccttcaaagctgttcaatagtgctgaatacacttcatataattcatctttcaatgtgtccatttcgaatgtcggtttcagcgtttggcgcactgtttccagttttgtccccgctgcctgcgtcatggcggttttcagcatctgccgctgcagccttttcttcatcgggtcgtccttgtgttctaaaagttcgtctaatgtcggcattatgtatccacctctatcatcttaaccagtttgcgagcatctggtctttttcctgaaattcgtccgctattttatgtaagaatccgccgatctcttcaaggtccgtgatcgccgcctgcaaagaatcaataaacgcctgctcagcctgtgtgtcgtaaaaaatcggtcctttatcgtaggattgcgcaatatcttcaattgtattggtcacgtcctgtgcttgaagctgatcaaacaagccgtgtccgacttggccgtaaaattccgttttcagctcggcgattttttcatcgtgctcctgataggcgttctgcgcttcttttttcatcgtccgcaaatcctcagtcatggcctgcaccttttcagccagcttctttgcgtttttcggcgttacttttatcgcgtctccgcttccgatcgcaccggccggcagaagagcgccgagatttttatcgaagactaactcatctccgttcggatttgtgatgtttccgtttcggtcaaatatgaaattcgcttcatttaagccgtgtgtatccggatttctcagaatgacggtagtaaagaaataagcgagatttttgccgatctgctcgttcaagttcccatcaagccgctgcttccggctgaactgtgagagtgaggggtttttcgtataaatcgttgtcccgttgtggcggtcatattcgttccaataacccgccccgaccatgtcgtccggattgataattgaccggatgtaaggatcgtatatgccgctgttgatgtctttctgtgtttcctcatcgtgcagtttcacgacggaagggctgttaaacgcgacggcgtacacatcattattcaccgcgctgtattcggcctcagcgccgccgagtgaatggccggttgttgaaataatcgttgatgttccggcatactttttctttacgctgcgtaccagctgatcggcttgatcgatttgcgatgttttcgttatcagcttatactttccggttgtgagcatggcgtcttgagagggcgttccattatattttccgagtgttttcgaggtatcctccgcgtctttttttacaatataatacacttctttttgcggatcattaccgaaaacaatattgccgccgtccgcttttacgccgtcattgatcgggtcttttccgatatcggttcccgcaaaagcgacgaccacgttttcggggttttttgattttatccattttccgtttttggacttgatgccttttgagaatacaaaggcatcaagacccgtatcagaatcctgcttcactttctcaacgtaccaatatgacgtcttacttattttataaggagttttatatttcatatgcagggctaacattttataattgtaagctgcttgactcaaacggtaatattctttatctgtgacatcagagacggttatttcttttccttttggcatatatacatcacctttcttatattgtaaaatagttccgaaaggatgatacgcatgagaaaatacattattatcctaattgttataattatagcagtgggaggttttttcgtgaagcatcaatatgataaacataaaaacgaagaaaaacttgtgattgaggcgcaagatcatatgaggaattacttaaaaaaagactataaaaatgtacaggaagttcacttttcaaaagactacaatatcgatccgacaggcggagttgaagtttcaggctacataaataataataaagaaaaagaattttccggtatatatgatccaacgaacaaggagataggtatttcagtggtcaatgccgaagaaaggtaaaatacccacctcaggatgagtgggtatttattttgtttaattatcttacaaaattcgtgatatgtttctcatacagttcaaacctattcctgagatcaatcgcctctaccgtctcatttgtcgaggtatccccgatattaacggtaaacgcgtacaaatatcatgacaactcaacgacaggaaaacgtcagatcagcattttactcgctttaagttccaatcttaacttgtcagcaacaatcgcgatgaattctgaattggttagctttgcttttgacatgctgaaagtatattcatatcaagttttcgctcatttcgtttacttaagaacgacagttatttataggaagggtttgatttccaaatgaaaaagaaaaagtacataattatccttattttaataattatagcagttgggggactttttatgaagcatcagtatgatcagaaggaaaaagagattgcgttattcgaagaagcccagaatcatatggaaaagtttttaacaatgaactataaaaatgtggataatatccatttttccgatgattaccatattaatccaatgggtggtattagtattaagggttatacgaatggaaaaaaagagtttgaaggtctatatgatccaggcaataaagaaatattatcatatacggttgatgccgaacccaaagaagaatgtaaagataagctttgtacaagataaattagccagctcaatcgagctgagctaattttgttttattgctcttactctatctcctcgacataaaacaaatcttccataggtacatttaatcctcagttaataatgaatagtgttgtgatatcatatcttgtatttgttttaaatctgcttatcgcagcctcagtagaaccaactaaatcagccaattccttctggatttgaattcctttctccttcatcacttcatttaacctagatctaactataactaacgcttataaaaaagtattctcgatcactgatacttgatacgttgatgttttttagacatgtacaacaccccgaggttgatataaatttaatctaagaaaggatgagtttgtgaagagatgcaaaattgccctaatatttgtgataactatagcgtcaggaagtatctacatgaagtaccaccatgattaaaaagaagcagaacaagaactttttatccaagcgaaaaataaaatggaaagttatataaaagctaattacaaaaatataaagcggattacatacattaacaattataaaataaatcctatgggtggtatttccttgaaggggtacttgaatggtaataaggaaaaagaatttttcggactttatgacaaaacgaatgatgaaataggagtttcgtcagtcgatgcagaagagaaacccgaatgtcaggaaaaagaatgtgaatactaaaaagacgctggaataaagaagtactctggattgccgcttatatgatcctctgcggacattaaagaaaaatcttaagaccctaaatgcatcggatgtcaccaccatttttccattccgcgagcttcatcataactgatgggacggatgattctgtgaaaaaatatattattatcttcattatcttaatagcagccggaggttttataatgaagagtatgaatgataaaaatgttcaggctgaagagataaagattgctcaagaacgaatggagaaatttatcaaagcgaattatgaaggcatacataacgttacatttaaagataaatatgaaacagatccaatgggcgggatagaggtatttggctattacaacgatgatacatcaaataaatttgacggtatttatgataaagcaaatgacaagattatgggacacactatagatgctgtgagaaagaaagaatgcagagataaagattgtgattactaagaagacgctcgtctgcgtttttttatagatgagcttaatgaaaaagacaagggtttcggcatgtgccgcccttgtcttttttattgaacactgtaaaacataaccggaaacagctcattatttgacagtccattttaacagcgttacaattaatcatgtaaatagttacatgtttaaacaaacatattgtctcgggaggtgatacgtccttgaatgaaccttctttaaaaaagtcatttatgagtcagtgaaacgcatcattgatcccgagcacgtgtatttccgcactgtgcctgtgtttgaaacaagcaatgaggcatatcagcatctgcaggaccggctgtttatcggggctgcggtcagattgccggatgacattcggttagatatttatgaaattcaataataagatggagagtgagtcaacatggaaaactttatcggaagccatatgatttacacgtatgaaaacggctgggagtatgaaatctatattaaaaatgatcatacgatcgactatcggattcatagcggaatggtaggcggccgttgggtgcgcgaccaggaagtgaatatcgtcaagctgacagaaggcgtatacaaagtgtcatggactgaaccgacaggcacagacgtttccttaaactttatgccgaatgaaaaacggatgcacggaattattttcttcccgaaatgggtgcatgagcatccggaaatcacggtgtgctaccaaaatgattacattgacgtgatgaaagagtcacgtgagaaatatgaaacgtacccgaaatatgtcgttcccgagtttgcggatattacgtatcttaacaatgcgggaatcaataacgaaacattgatttcagaagcgccatacgaaggaatgaccgatgatatccgtgcgggaaaattaaaataagagaaaaaacccggcagcttggccgggttttttgtatccttttacgagagggttttggtcatgataaagtcgacttgtttatcatcccccatataaaaagagtgttctccggtttggacaaaccccattttttgataaaaggcgattgcattttcgtttttttcccatacgcccagccagatgttctttttattgtgtgctgttgcgattttcacagcttcattcagcagatatttgccaagcccgtgtttctgatggctttttcttatataaattctctcaatctcaagagaatcttcccccattttttctgactgtgcttcgttcatgttgacttttacataccccgcaaggtcatgatgataataaacaaaatagaattgagaagacggattggataattcctttttcagctgttcagagcggaatgcattttccaaataagctttcatattttcaggtgaattttgatctttaaatgtatcattgaatgtttcaatgcttatctcccggagctctgttatatcgttaaggctgcacttttttaatttaatactcagggtcatacagctcctttcttcatttatcataccagctgaattttgttgtatttgcaatgaaaataccgtatagtaaacataccgtaattttgttgtatttgcaacataaaataagaaaatgaggacgataaagtgaaatatgttttttatgttttaggaatcatgatcttgacctttggtatttctgtcacgattcaatcagatcttggaacatcgccttttgatgcgcttattgtgggattgtccgtccatgcagggcttaccgtgggaagctgggaaatcatcatcgctttcctgttaatttgctgtaattcaatgttaaaaaggcaaagaccggaattttcagggatgattacggcgttcataacgggaatcgggattgatatgtggcttttttttctgcatcgagtcataacgcctgaactatggtacggaaaggcgggctgttttgcaatcggtttagttgtgatagggataggaaccgcaacctatctgcacacaaatttcgcaccgatcccggttgatcggttaacgctaattgtccgtgatttaaccgggagaagcatctttttttcaagaacggtcatttacttcatatttttcatactggccttgatgctaaaaggtccggtaggcatcggaacgttattaaccgtttgtttaggcgggatcttccttcatttctttatgccgattaccggaagatggatagacggcatattaacagcatctccaaagcaggaaaaaacgaaaacccggtaacggcggtttttacccgattctatcatttttcatttcacccgcatgtttaaggtataataaaaaagggggagggatttttatgagcggtcaaagaaagctcgttttttacggagctgtcagcgcagatggctatcttgcgcgggaaaatcattctttagattggttaatcggaactgaaggtgaagacagcaccgattatgaagctttctatgaatctgtcgatacgatcattatgggcagaaaaacatacgaggaaatattggttttattgcctgaggaatttccgtacaaaggtaaagaatgctatgtgttttcgcggacattgaccgggcgtactgaacatgtgcggtttattcatgaagagcctgccgattttataaatgcattgaaacgccaagaaggcaagcggatttggattgtcggcgggagtgatctgctgcacccggttttggaggaaaaacttgtcgatgagtttatcattcagatcgcccccgttctgctcggccgcggaatttctttgtttaaacccggagaccgggagacaggactgaagctgactgatgtcaggcgttacaaacaatttgcggagttgcattatgaagtgagataaaatgaaatgtatgaacgaaacccagtaaaggttaccgggtttctttttcatgtttgtttttatgttttgaaatggtgtgggccggaccgcatgaaaatcctgcaaccatgataacaacccctatccacctcacggcatagaaatcagtgtcgcgcaggaagataaatgaaactaagataataagcgccccgattataacggcagctgtgccgataatacttgatttctccatatagaaactcctttatgaatgtttggttaacgtattgggttggaatataacatatcaggggtaatgcggaaatggatatgctgcgaagctgactgatgtctgtaagatgaaaatgaaacgccaagggagccggctcccttggcgttttttatgcttgaaacaggatgcggcgttttgctgaatcgggatcactttcgacagcggtatccgtgttgaaaagcaaagtttcgcgtgaatcggtttcatattcaggccaattgaagtgagaggtgttcgggtttccggtttttgcaaaagcgagccatgcggattgaatttgtttggaaagctgttctgcgtcatcaccgagcggctcttgcagcgtctttctcaaagaatcaaagtttccgaacacaaacggcaattccagagcgtgaacggctttatgaaacggcggtgtttcgccatgccaatcaaagcggtacatccagaccggtgcgtgttgcgactgtccttgtgcgaaagcgacagccggccgccagaaaatcagatccgtcatcatatcgatttgtccctttaatgaatgcggatataaatctgccgcttgctcggtgcagttttctccgaggtgataatgcaaataatcttgctgctttttctcggagtgaatgtctgtatcaggggtgaaaaacaaatatgcttcatcacgattggttccgatgatcataggtatgccttctgcggccccgtctgctatggctttcaccggttccgcaggcaatgtggccggatcgatggcgggctgaaacaaaagctgaaaaatgttttgatccagtgagcgccgcactttatccgcagtcttaagcaggtcattaacggaaagctcctgcaattgatcagtgccggcttcatgaataaatgccgccgcgatgtcttttgccatatccgccggcatcgtatgagaggcgccgctttctaaaatggctttatgaaacaggccttttgcgtcaggcattgccataagcgcagcgatgctcatgccgcctgccgattcaccaaatatcgtgacgttatccgggtctcctccaaattcggagatattgtccctcacccagcgcagcgcggcgatctgatcgagcagcccgatattggcggaatacgcgtcatgaatagaagacaaatgtaaaaagcctaacggtccgagcctgtaattgagtgtcacgacaatgacatctccgtcagcggcaagggcagatccgtcgtaaagcggttcgcttccggcacctaaataaaatgccccgccgtgtatccataccatgacaggctttttttcgccctctgaatcgggggcgaaaacgttgaggtaaaggcaatcttcagattgaggcggtatatctccggaaaacgatatggacagcatatcatccggctgcggacaaatcggcccgaacgaatcggcatgttttatgccgtcccaaggtgcgggcggctccggcgctttaaatctcagctctccgacgggcggcttcgcgtacggtatgcccttccatgtgcgggcaccgcggccggcagttcctttcagtgcgccgcagcgggtttgaacggtaagttttgtcatgatttcatccccttttttcttttcattataaacagagatgaaggcatgaagcgaataaaagccctttcatcagcatatcatcagtaacgcttccgttctaaaaatgatctgacttcctgaacggacaagccgagttcttttgcttcctgcatcagcgctttccattcttcaatgttggattcagtcagttttctgttacggtaggatgcgggctccgggcgcttttcagtcagtttgttcgtaaaggtgaacagttcttctttcggcatgcccgactgcacggcctgcacaaggtggatgcgccactcatcttccgtgcctcccatgtgatgcagcatcgtttcggcatcaaaaagctccgtcagatcgacctgcagggtggcggatacttttttcagaaattggatggacggatttgagtgaacccccgttctatcttgcttaaataagatttagagacacctgcttcaactgctagctgattaatagagtagccttttcttctgcggtataaacgaattattcttccaatcattgtgctgaattctcccctgtatactggcatttttttgttcattataagaaatttttcgttctttataaaatttaaaattataagggaagtgcagtaaataagaggaaaatcatgataatgttctctaaaaagaactaaatggcttaatttgaaattttcaaatttcgaccttttcttttataatccaatcattaacagaagggggcgtttaagcctgatgcaataaggatgaggctgtaattacatgaatgagaatatgagttttaaagagttatttgacattattaaacacagatttttactgatttttatcatgacagcagttgtaacgctgatgacgggatacatccaattccgggtgatttcgcccgtttatcaggcatcgacccaagtgctcattcatgaaacaagcggtgaaaaaaattcgaatctcagcgacgttcagctgaatcttcattacaacaatacgtttcaaacgataatgaaaagcccggttgtgcttgagaaagtgaaacagaagctgcatctttctgagacggcatccgctttaaaagcaaagatcacgacaagcagcgaaaccgattcagagatcattaacgcagcggtgcaggacgagaacccgaaacaggccgccgctatagcgaacacgctgatgaagacatttaaaaaagaagtccgtgacaggatgaatataaaaggcgtcattgttttgtccgaggcaaaagcatcggaaagcccgatggtcaagccttcgcgcatcaggaatatcatgatggcgttcggtgcggctctcatggcgggtgtgacgcttgcgttttttctccactttcttgatgaaaccgttaaaagcgagcggcagctcagcgaaaaaacagacttgcctgttttaggggttgtgtatgacatcaaaaatcagcagacacggtctgatgaaaaacatttcggggagtgaggcgtttgggattcagaaaaaagaaatcaagaaggggactggctcaaatatccgttttacatcacaaatcattggtggctgaacaatatcgcaccattcggacaaatattgagttctcctctgttcagacccatttgcgctctattctcgtcacttcctccgttccgggagaaggaaagtcattcagcgccgccaaccttgccgcggtatttgcgcagcaggaaaaaaaggtgctgcttgtcgatgccgatttacgaaaaccgacgatacacgagacctatcagcttgaaaatgtacaaggccttacgaatgtgttagtcggaaacgcttccctcggcgaaacggtgcaaaaaacgctgattgataacctttacgtcttaacgagcgggccgacgccgccgaatccggccgagcttttatcttcaaaggcgatgggagagctgattcaggagatgtacagccggtacagtctggttattttcgattcacctccgcttttggcggtggcggacggccagattttagcgaaccagacagatggaagcgttctcgtcgtcttgagcggaaaaacgaaaatggataccgtccaaaaggcgaaagacgcgctccagcagtcaaaggcaaagcttttgggggcgctgctgaataaaaagaaaatcaaaaaaacagagcactactcgtattgagcggtgcaggtgatgtctccttacctttatcaacggaggcactcggctctgctgtgggcggcgttttccgccgccttagatgctggtcgtcggtggcggggtgtgaggacgggttaaatgcccaatttatcttaagatgatgcattgttatcggcttagctgttatgtctgtttttacgaaaaccgtatcagctaaaccgataaatgaggaggggaaagattgacttaccggagaagactttcaatgatttttgcattggatacgtatctcgttttactttccgttgttataggatatcaattttttgaggattcttatcacttttatgactccggagcgttgctgctgaccgccgtgaccatgctgatcagccatcatgtatgcgcttttatgtttcaccagtataagcaggtatggacgtatacgggaattggcgagctgcttgatctgctgaaggggatcacgctgtccgcagctgtcacagccgccgtccaatacggggtgttccacacgattttgttccggctgttagccgtcagctggatggttcagctattgttcatcggaggaagccggatgatttcgcgcgtgctgaaagaaacgatcggcaggaagcaaaatgactcttcccgggcgctgatcatcggcgcaggcgcgggaggaacgctgctcgtccgtcagcttacgcagaaaaatgatctcggaatcatgcctgtggcttttattgatgatgatcagacgaagcataagctcaaaatcatgggcctgcccgtcatcggcggaaaagaaagcattatgccggcggtgcaaaggctgagaattcaccacatcatcatcgccattccgtctctttgcacccatgagctccagacgctgtacaaagaatgtgtgcagacgggcgcccatattaaaatcatgccgcaatttgatgagatcctgctcggaacgcaggctgccggacacatcagggatgtgaaagccgaagatctcctcggcagaaagccggtcacccttgatacgagcaaaatttctgacagcatcaaagggaaaacgattctggtcacgggcgccggcggctctatcggttctgaaatctgccgccagatcagctcgtttcttccgcatgaaatcgtccttctcggccacggggagaacagcatttattcggtgcataacgaactgtccgcacgcttcggcaaagaggtgctttttcacgcggagatcgccgatattcaggacagagataaaatctttacgttgatgaaaaaatacgagccgcacgtcgtctatcatgcggccgcccataaacatgtgccgttaatggaacataatccggaagaagccgtcaaaaacaatattatcggcacgaaaaatgtcgccgaagccgccgatatgtgcggaacggaaacattcgtgctgatttcttctgacaaagcggtcaatccggccaatgtcatgggcgcgacgaagcggtttgcggaaatggtcatcatgaacctcggaaaggtcagcaacaccaaattcgccgccgtccgtttcgggaatgtgctcggaagccgcggcagcgtcattccgattttcaaaaagcagattgaaaaaggcggacccgtcaccgtcacgcatccggcgatgacaagatattttatgacgatccccgaagcgtcaagactcgtcattcaggcgggggcgcttgcaaaagggcggcagattttcgttctggatatgggagaacccgtcaaaatcgtcgacttggcaaaaaacctgattcatttatcaggctatacgacagaacagattcctattgaattctccggcatccgcccgggagaaaagatgtatgaagaactgctgaatcataatgaagtacatacggaacagatttttccgaaaatccatatcgggaaagcgatcgacggggattgggccgtgctcatccgttttatggaggaattcagccgtctgcctgaagatgagctgagaaaacggctgtttgaggcgatcgaatcagtacatgaagaagcggccgcaggtgtgtgatgggaggacagaaagatgacgaaaaaagtattattctgcgccactgtcgattatcattttaaagcctttcatcttccgtattttcaatggtttcaggatatgggctgggaggtgcacgtcgcggcaggcggcaatatgaatcttccattcgttgatgaaaagttttccattccgatccggcgctcgccgtttcatcccgaaaatctttctgtttacaggcggctgaaacggctcattcaggctaacggctacgacatgattcactgtcatacgccggtcggcggcgtgcttgcacgccttgcggcgagacaagcgcgccaaaaagggacaaaggtgctgtacaccgcgcacggctttcacttctgcgatggagcgcccctgaaaaattggcttctttattacccgatcgaaaaatttctctcttcttacacggattgtttgattacgattaatgaagaggattacgaacgggccaagcaaatgaaaaaaacagcttgcggcgcgaagaaaatacacggcatcggcgtgaatacagacaggtttcgccctgtgagccgggcagagagtgaacgtctgagagaaaaacacggcttcggcgccggggaatttatcctcatataccccgctgaattaaacggcaataaaaaccagggacttctcattgaggctgcggcactgctgaagaaccgcattccggagctgaaactcgtatttgccggagaaggcgcgatggaagagccgtacagaaaaaaggctgaatcactcggggtatccgacattgtgcggttttacggtttttgccgtgacattcatgagctgattcagcttgccgatctgtccgtcgcctcaagcatccgcgaagggctcggcatgaatctgcttgaggggatggctgccgaaaagcccgccgttgccgcagacaacagggggcaccgtgagatcatcgaagacggtgtgaacggttttctcgtgccggcaggggacagcgcggcatttgccgatcggattgaaaagctgtaccgatccccgggtctgcgaaaagcaatgggacaagaagggcgcaggacggcggaatttttttcagaaacacgtacggtaaaggaaatggcgcacatttacgccggttatatggataaaaaggagaaaagcgtatgaatgcaggagcacaaccgaaaatttccgttatcatgggaatttataattgcgaagagactttagcggagagtattgaatccatcctgagccaatcgtataagaattgggaactgattatgtgtgatgacgcgtcaactgacggaacgtatcagattgcgcgccgttacgcggatcattacagcgaccggatcacgctgattcaaaataagacgaatcaacggcttgccgcttcgctgaaccgctgtctgacatacgcaacgggggattatatcgccaggcaggacggtgatgacatctccaacccgaggagactggaaaaacaggccgctttcttaaacaagcacgcccactatcaagtcgtgggcacggggatgctcgtatttgatgaattcggcgtcaggggcgcccggcttttgccgcccgtgccgaaaccgggaattatggcgaaaggcacaccgttctgccacggcaccattatgatgcgggctgaagcgtacaaagcgcttggaggctaccggtcagtcaggcggacgcggcggatggaggatatcgatttgtggctgcgcttttttgaagcgggtttccgagggtacaatctccaggaaacgctgtataaagtaagagaggacagtgatgcgttcaaaaggagatcgtttacgtattccattgataatgcggtgctcgtttttcaggcatgcagacggctgaagctgccgatttcccattacgcgtatatcgcaaaaccgctcatccgcgccattacgccgcccgcggtcatgaaccgttatcataaaaacagggacatccgccaaaaagaagggcttgccgaacatgactgacaaaccgatgcgggtgctgcacatcttcagcgggatgaacaggggcggcgcagaaacgatgatgatgaatttgtaccggaagatggacagaacgaaggtgcagtttgattttttaacccataggaacgatccgtgcgcttatgacgaggaaattctcgctctcggcggacggcttttttatgtgccgagcatcggcagcacaaacccgattacatttgttaaacaggtcaagcgggtgattcaggaaaaaggcccgtttgccgccgtgcacgcccataccgattttcagtcgggatttatcgcgcttgccgctcgtttagccggcgtcccggtgcggatctgccattcgcacagtacgtcgtggcgggggcgggcgtcgcggcttgccgggatgcagctgtttgttttcagacggctgatcacggcaaacgccacggcactgtgcgcctgcggaaaagaggcgggccgtttcttattcgggaaagaaaaagacgtgcatcttttgccgaacggcattgatctcgacttatttgccggcgggtgcgcggacacagaagctgaaaaaaggaagcggggcattgcagacggccgtttggtgatcggccatatcggccgctttacagaagaaaaaaaccacgaatttctgctccggctggccgctgatatgaaagagcggggcatcggcttacagctgattctcgccggagacggtccgcttcgcaccgatatggaaaatctggcggcgaagctggggcttgatgatgatgtgcgttttatcggcatagaagaccgcgttcatgatctgctgaaaacgctggatgtatttgtcatgccgtctctttatgaagggctgcccgtcacgctcgttgaagcgcaggcctccggggtgccgtgcgtgatatcagacggcataacggaagaagccgatgccgggctcgggctggtcaaaaggctcagcctcaaagaaccgccgggacaatgggcatccgcggttttacgggcagcagaggcggcaaagcctgacggggcgcgtattaaagaaaccctcaggcggctgggatatgacgcgggagaaaatgcgggggctgttatgaagctttacaatatgaattggaaaaaggaacagtaacgaatgattgtatatgtagtcaatatgggaattgtttatatttggtcatggttcgcgaaaatgtgcggcgggcgtgatcaatcgctttcgaccggataccggccgaatcagctcgtcatgctcgttccgctgctatcgctggtattggtctccggtttgcgctacagagtcgggacggattttcagacgtacgcgctaatgtacaagctggcgggaaattacggcagcatttgggagatcttcgggttcggagcgaaaaaagcagccgttgatccggggtttacggctctcatctggctcatgaattttatcacgaaagatccgcaaatcatgtatttcaccgtggcggtcgtgacatgcagctttattttaaaggggctcgttgagttcggccgtccgtttgagctgagtgtatttttgtttttgggcacgtatcactattacgcttcctttaacgggatcaggcagtatatggtggcggccgttttgttttgggccgtccgctacgtgatcagcggaagctggaagcgttatatgtcaatcgtgctgctgtgttcgctttttcattcctcagcgctgattatgattccggtttattttctcgtcagaaaaagagcctggtcgcccgcgattttcggactgtcggcattgtttcttcttatgacgtttctgtatcagaagttcatttcgctgtttgtcgtcgtgctggaaaacagctcgtacggccattatgagaaatggctgatgacgaatacgaacgggatgaacgtcgtgaaaatcgcggtgctgctgctgccgctgtttttggctttctgctaccgggagcggctgcggaagctctggcctgacattgatgtcatcgtgaatttctgtctgctcggcctgctcttcggtcttttggcgacaaaggatgttatttttgcccggtttaatatatatttcggcctgtaccaaatgatcctgatcccttattttgtgaggatttttgatgaaaaatcaaatgcgctgatttatatcgccattattgtctgttattttctttacagttacttgcttatgccggtcgattcgtctgtgcttccgtacagaacgattttttcccggtaatggacactggaggtttatatggaaacacccgcggtcagtttattaattgctgtgtataatacggaaacttatttagaaagatgcttagattcattgctcaatcagtcgctcgccaatatcgaaatcgtggccgttaatgacgggtcaacggatcaaagcccggcgattcttgaaacctatcagaagcgggatgagagaatcagggtcgttcatcagcaaaaccgggggctcggcgcggtccgcaacaagggcatcgaggcggcgcgcggcgaatttatcgcttttattgatgcggacgactgggttgaacctgattattgcctgcgcatgtatgaaaaagcgaaggctgatcaggctgatctcgtgatttgcgaatatgcggctgaatttgcggatacggggaagaccgccgtttcaacgatcgcttcagcgtacgagggccgcccgaaacaacggtacctgaaagatttatttgaaggaagagtcagcggcttttcatggaacaagctgtacaaaagatccatgatcgagcatcatcagctgcgctttccgcttcgtgatgagctggagcacgtggaggatcagtatttcagcctcagggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacacgaataccggcaggagctggattttttcatcgttcagcacggaacagtctgcctgctgaatgaatggaagcggaataacggcggccggttttctgagaagtggaagaatatcagccggatatgcgctgatcccgtattccgcatgagcctttccaaaacgggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatctcgcggaatggcttttgcttaaggtcaaatacccgtcccaatttcatttcggaacgggagcggatggggcggcggggcttacagcggcaagaaaaaagatcattctgacgctgctcccgtcccacgataatctcggcgatcacgccatcgcctacgcaagcaaaacgtttcttgaacgggagtatcccgattttgacattgtcgaggtggatatgaaggatatatacagatcggcaaaagtgctgatcaaaaagcgccaccccgatgatatggtattcatcatcggcggcgggaacatgggggatttgtaccggtatgaggaatggacgcgccgctttatcataaaaacattccggcaatatcggatcgttcagcttccggcgacggctcacttttctgaatcaaaaaagggacggaaggaactgaagcgcgcccgaaaagtgtacaatgcgcatcccgaccttttgttgatggcgagagatgagacgacgtatcaatggatgaagcgtcattttcccggaaaaacagtgctcaaacagcctgacatggtcttatatttggataaaagcgagcggggcatagcgcgggaagggatctacctctgtttacgggaggataaggagagcgcgctgacggctgaggacagaacgatggtaaaagaagctttggccaaagagtacggagagctgtattcctttaccacgacggtcggccggagggtcagccgccatacacgcgaaaaggagctggaagcgctttggaatacgctgaaaggcgcggaagccgtcgtcactgacaggcttcacgggatgattttttgtgcgctgacgaaaacgccttgtgtcgtcattcgttcgtttgatcataaggtgatggaaggctatcaatggctgaaaaacataccgaacatgacattgcttgaacgtcccgaccctgaagccgtaacatccgccgtaaatcggctgctcagcggcaagcatgaggaaggcggttctttgcgaagtgtttattttgccgggctgcgctcgaaaatcagcggtgatgcccaatgaccgcgccgcttgtgagcgtgatcgtgccgatgtataagacagagccttttattaaagaatgcgcggtttctttaacaaaacagacgctgaggaacatcgaaatcattttcgtcaatgacggttcaccggatcagtcaggccggatggctgaacaattcgccgcagaagatgcgagaatccgggtgattcataaagaaaacggcggcctcagctcggcccgcaatgccggaataaaagccgcccgcggccgttatatcggttttgcggacggcgatgattatgtgacggaaacaatgttcgagcggctttatgaagaagcggagaagaaccggctggatatcgccggctgcggttattacaaagaaacgccgtctaaagaaagaacgtatatgccgccgtcccttccgccgggccgcgtcttcacagcggatgaaatgaccgcattgctgacccgcgcgcacgaacatcggtttatttggtatgtgtggcgctatatataccggcgagaagcattgcaagggctgttgttccatgaagatatccggtttgccgaggactctccgtttaacttggcagcgttccgccaagccgcgcgtgtcaaagtgatagacgaagggctgtatatctaccgggaaaatccgcaaagtcttacagaaacaccgtttaagccccgcttagatcacgaactgcaaaagcaatatgcagcgaaaatggctttttatgaggcaaacgggctgacggacgcctgccggagcgatattgatacatatttgtgcaagcatcagattccgatgctgatcgccaacgcatgcgccgccccgcagccgtcacaccagattacggcgcatatcggcagaatcttaacgtatgacatggtaaaaacggccgtgcgcaggacgccgtgccgccataaacagctgctggccggggagcgcgtggtgctcggtctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgttgaggcttttgggtttgtccatctgacacagaatatcattaactatttctctattattaccgttgcgctgagctcagtcgttgtgaggtttttctccgtcgccgcccacaggggaacagggacgaggccaatgcgtatgtaagcaattatttagccgcgtctgtcgtgatatctctattactcgctgtgccgctcgccgggactgctttttttattgacaggattatgaatgtaccggccgggctcttaacggatgtgaggctgtctatcgtaatcggcagcgtgctgtttatgctgacgttttttatggcggggttcgcgacggggccgttttttgccaacaagctttatatcacaagttccattcaggccgtgcaaatgctggtcagggtgctgtgtgtgctcgctctgtttacgtgcctgccgccgaagatctggcagatccagctttcggcattagcgggagccgtctgtgcagctgtgctgacttttttcttctttaagaaattgattccgtggttttctttcagccgtaaaactttatcattacagacaagcaaagtgctgttttcggccggtgcctggagttctgtcaaccagatcggcgtgctgctgtttctgcagattgacctcatgacggccaaccttgtgctggggccgtctgaagcgggtgtctatgcggcgattattcaattcccgcttctgctcagaagtcttgccgggacgcttgcttcactgtttgcgccggttttgacttcctattattcaaaaggcgatatggaaggtctcctgtcttacgccaataaggccgtgcggatgaacgggcttctcctcgcgcttcccgccgcgttattaggagggcttgccgaaccgtttctggcgatttggctgggcccgtcgtttgtgcagacggcgccgcttttatatattcacgccgcgtatttggtggtcagtctctctgtcatgccgcttttttacgtatggacggcttttaataaacaaaaaacgcccgccgtcgttactttatgtttaggcggactgaatgtcatattggccgtggttctcagcggaccggcacatctcgggctgtacggcatcaccattgccggggctgtctccctcattttgaaaaatgccgtcttcacgccgctgtatgtttcgcatattaccggctttcagaaaaccgcgttttacaaaggcatgttcggcccgttggcggcggccgtatttgcctgggccgtctgccggggtatccggctgttttcaccgcttgacggctgggccggtctgatcgccgcggggcttgccgtatgcataagctatgccgcattcgcttttttcttcatttgtacgaaagaagaaaggcggcttgctttacagaaatgccgaaaagtgaaaggagctgttcagatttgaaggtgaaacgtgtatttgatatagcggccgcgacgctgttattgtgcggcgcgagtgtcattcttctcttcgccatggcagccgtcagatgcgccatcgggtctccggtattgttcaaacagacgagaccggggcataacgggcgtccgtttacgttgtataaactcagaacgatgacggatgcgcgtgatgaaaacggtgtgctgcttccggatcatctgcgcctgaccaaaacgggaaggctgatcagaaaactgagcatcgacgagcttccccagctttttaatgtgctcaaaggcgatatcagtctggtcggcccccgccctttgctgatggattatctgccgctttacacggcggagcaggcgcggcggcacgaggtgaagccggggattacgggctgggcgcaggtcaatgggagaaacgcgatttcatgggaggagaaattcaagctcgacgtgtggtacgtcgacaaccgcacctttcttctcgacttaaagattctgcttttaacagtgaaaaaagttctcgtgtcagaaggcatacaccaagccggccatgtgacggcaaagcgcttcacaggcagcggagatatgtcatcgtgaaaaaggtcgtgctgatcggaaacggcggacacggaaaagtcgtgaaggaaatcgtgcaggcccgttccgatatggagcttgcgggcatattggacgacggattcagcggttttaccgctcggaacggtttatatacgggccggacggaagacgtgcacatgcttcggaaactcgtccccgaggccgtgttcacgatatgcatcggccgcaacggcgtcagaaagcagttcgctgaaacgcttgggattgaagctgccgattatgcttcactcattcaccccggggcgatcgtcagtgaaacggcttccgtcggacacggaacggttgtgatggcgggcgccgtcattcaggcgggcgctgacatcggcgcccattgcatcatcaatacgggggcggttgccgatcacgacaatgcaatcggagattacgtccatctttcaccgcgcgcggcgcttgccggcggagtgaaagtcggggaaggaacgcacatcggaatcggcgcgtccgtcataccgcagatggacatcggcccttggtccgttatcggcgcgggggctgcggtcatcagcagaattcccggccatgtgacggcggtcggcgttccggcccgcgtcatctcccctatccataatgaaaaaggatgatttcatgcaaacaaacaaacggatttatttgtctccgcctcatatgagcggaaaagaacaggaatacatcgcagaagccttccgaaccaattggattgccccgctcggtccgctcgtcaattcgtttgaagcgcggctcgcggaatatgcgggagtgaaaagcgcggcggccttaagctcgggaacggccgccatccatcttgccctgcggcttgcgggtgtgaaaaaaggagacgttgtattttgtccttcctttacgtttgtcgccacggcgaatccgattgtgtatgagcaggctgagcccgtttttattgattcggaatgggagacgtggaatatgtcgcccgctgcgcttgagcgggcgctccgggatgcaaagcggcgcggcagactcccgaaagcggtgatcgccgtcaatctttacggccaaagcgcgaaaatggatgaattaatgagcctttgtgacgcatacggcgtctgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcacaggcgagagatgccgccgttcattaccagcacagcgagctcggttacaactacaggctcagcaacattctcgcgggcgtggggatatcgcagctggaagtgcttgaagatcgcgtccgggcgaggagagaaatctttcaccggtatcgggaagcgctcgaaacatatccgggcatccgcatgatgccggagcttgaaggaacggtttcaaaccgctggctgacggctctgacgcttgataacggcgtgacgccggaagaagccgtcgcctgtcttgcggaacagaatattgaggcccggccgctgtggaaaccgctgcacacgcagccgcttttctcatcttccgtcttttatcctcacagcgaccatgagcgtgtctctgagaaccttttcagccgagggatttgtctgccgtccgggtctgacctgtcttctgaggagcagcagcgtgtcattgacgcacttgcgcaactgtttgaaacgaaaggggagaaaacatggacagccgccatgttatgagccgattaaaagagacgctgacgggtctgctcagcgttataccgccgcaatccgacatcatatatgccgactatcccctctacggaaatgtaggggatttattgattatgaaagggacggaggcgttttttaaagcgcacggcatccgcgtgaaacagcgctggaatcccgacaattttccattcgggcgccgggcggacaaaaagacgatcatcgtctgtcagggtggcggaaatttcggggatctctatccgtactatcagacgttcagggaaaaaatcgtcaaatcctttccggaaaacaggatcgtcatcctgccgcaatcgatttattatcaggatgagacacggctgcaaaagacatcggcgctttttgcggagcacaaggatctccacctgtttacgagagatcatgtgtcatacgagactgcgaaacgctttttttcggcgaatcatatcgggcttatgcctgatatggcccatcagctgtatccgatcgcggcgtcagcggttccgtcacgcggcaggctttattttatccgcacggatggggaaatcaacccgaagctgcaaaacaattcttccgttaaaagctgtgactggcaggatgttctgtcagcaagcgaccgcaggggaatcgcttttttccaaacgctgaatgttttgaataaaaaagcgggaaacccgctgccgattgcgcggttttggaaccgctattccgatttcttaacgaaaaaagcggtcctgtttttcagcaggtacgaatcggtggaaacgtcaaggctccacggccacatcctgtcctcgcttctcgggaaaccgaataccgtcattgataattcatacgggaaaaacgcgaactattattacacctggacgcacgaagcgccggacgtccggctgatcggtgaaaccgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgtacaagggttgagacgacggagcggtaatagctgttcatcgcatgaattcggtcttcattcggattcatttcaatgtgctgtgtaaagttttcaataaaatagggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggccatcacattactcggatacaattccgcggaactggccggatatattgatgagctctcactggaaaaccctctgattgaacgaaaggaaacagacacgccgccactatcttaccataaaacaaataaaaacaggatgaaagaacgggacggaagccagcagatcagacttacccgcaaaacgctgcaggattcgctcaaacagcaagccttagacatgaagctgtccgatgatgagaaaaaaattttcaattatctgatacattcattggattcaaacggttatttaaaagaggacataccagccgccgccgaccatgtatccgcttcacaagaggagacggaagcggttctgaaaaagcttcaatcccttgagcccgcgggaatcggcgcccggtctttgcaggaatgcatccttcttcagctccgccgtctgcccgagcggaacgaacaggcggaatggattgccgaagcctattttgagctatttgcaagaaagaattggaaagcgcttacacttaaaacgggcattccgcttaaagacattcaggacatcgctgacatgatcagcgcgcttgatccgaggccggggctccgttatgcgcatgaggagccgggtttttacgtagaaccggatattttcatcacggtgaaaaacggcatcattcaagcgcggctcaacagccgttcgtttcctgacatccagcttcatgcccattatcagccgctcttgtcagccgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcatcgggggacggcggcgcctccaattatgccgtaaaagcgcatctggaagcattggtccgtaaagaagataaaaagaaacctttttcagaccaaaagcttgccgatctgctgcatgaacaatatgacatccgaatctcaaggcgcaccgtcgccaaataccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaagcggaaaaggtcggcttccttgcccgccagaccgacagcggcacaggcaaccgcaatggattgcggagaaatcatttttccggtgacaccgcctgatgaattggcggcaacggagagaaccgggtccatcccgacagatagcgccgtcaccttttgcaatccgccgaacaataggttggccgatgtatcagagccggtaataaatacgccgagccagccgagcaccggcgaaaaaaaggtaaacatcgcgcccgtcatggcaagcgcaagaccgagtgtcgtgctcatgccggaagcattcgtcacatatgcaaagccgacaacagaaacaatggtcacgaccggaagcgttaactctttcaccgtttctataaacgcttcgccccacgtcttccacgacatgccgagggcgaacttggagatgacggcggcaatcagaatcgccgttcccgctgaaccgaaaagctcaagtttgtacacggcttcaatcggcgtgccgtccgcctgaagaatctgctgatttacaaatgggacgggaggcgtgaaggtcaatgctttcccggctgcattcagccaggaaagccacattgacgttccttcataatgaccggttaaagcagccttcacgccgggaatcccccaaacggatatcatggccgtcagaagaaggaaaggagaccacgctttaaacaccgcggcgcccccgtacttgatcggcgcccggtcagcggccgctgctgattcccgttctgccgcgaaacgaaaggccgttttcggtttccaaaatttcaaaaatacagcgagcgcggccatggaaacaagcgccgacagcacatccggaagctcaggccctaaaaaattcgagcttgcgtactgcacggccgcaaaggagacgccggaaacaagaatggccggccatacttcaaaagcctttttaaacccgctcatcaaaatgattaagtaaagcggaataaagacggataaaaaaggaagctgccggccgaccatttgggaaatttccattgccggtatcccggtcggaccttcgacggcggtaatcggaatgccgatcgcaccgaaggcaacgggcgccgtattggcaatcaggcaaattcccgccgcatacagcggctgaaaaccaagtccgacgagcaaagcggccgagatcgcgacgggagcgccgaaaccggcggcgccttctaaaaatgccccgaatgaaaaggcgatgagcagcgcctgcaaacgccggtcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgttaaaagccccgctatgtaccccttcatccgtttcaccgcaagcgcccaaaaaaagaagataatcggcacgagcgcgcaagctgccgataaaagcaaatttccccctaaaggagcgtacccctgtgtccattgcatccctaaaaaacccctccttatgtcatgtaaacgattactttttatgataaggtcatctgatgaccgggttaattagcattatattttgaaagttttgaaagtacaatacttttcttgaacaaattgtctgaacctgtcggctacacaaaaaaagaagtataatagacgataaacatcaagattcacaagtgacggggtgatcgcgttgaaatataaacaaattaaaacgaaaaaaatctacgaggaagtcgctgacgcattgctggagaagataaaagcgggcgagcttaagccgggggaaaagcttgattctgttcaggcgctttccgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgccctcttgatgaaaaaagaggacgtcaaacagctgctcgaagtcagaaagctgcttgaactcggcgtcgccgccatggccgctgaaaaacgcaccgaagacgatttacaaaaaatccgccaagctctcatggagatgaaagacattgacggagacgaagaattgggcgaaaaagcagatttctcctttcacatggcgctggcggaagcatcacaaaacgggctgcttaagcatctcatgaatcatgtctccgcgctccttttggaaacaatgagagaaacgagaaaaatttggctgttttctaaacgaacgagcgtgcagcgattgtatgaagagcatgaacgcatttacagcgccgtcgccgccggagacacggatgaagcggaagcagcgatgacggcgcacctgacgaatgtggaagaagtgctgggggcttattttgaagaaaatgtatagaagctgacttgtgaaaggggataacatcacatgcaggccgaatcttttttttctgaccatgtaaagaaagctctgacaaatgatcctcccggggaatggatgccggcagttccgaaagcgtgcatccctctgcattccggctatcccgatcccgcgctcgttcctgataaggagctgaaagaagccgcctcccgccttctggatgaggagcgtgatctgccgctgcattatataggaagcccgaggacggccgttttaaaaaagcagattcaagaacggttagccatccgcggcattcactgccgggacgatgagctgatcgtgacatcaggcgcctgtcaggcgatagatctggctgcgcgggttttcctcgatgaacaaaccgccgctgccgttgaagctccggtctatatggaagcgctcgagatttttaaaaattatacaccgcatatcatgagcattccgacagatcaagagggtctgcaaacagaaacattagcgtttatgcttgaggaaagaaaacgaaaagggcttgtgcttccccgtcttctctacacgatacccgcttttcagaatccggcgggaaccgtaatgtcatcgaagcggagaacccgcctgcttcagcttgccgaaacgtatgattttctcatcttggaggatgatgcatacggcgagctcggattcaccgatattccgccgcccttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccatccgttttcccaagcggtgaccgccgtctatctggaacaaacgaatattgaagaacggctcgccgccttgcgggaagcatatcgaagcaaacgtgatgttttgctcgccgcatcagcgcgatatcttccggaatccgcatcctggcacgtgcctgaaggcggttactttgtatgggtgaaagcgccgggggctgatacgtccgcactgctggcgagggctctgtctcacggcgtttcctatgtacccggaaaatatttttttccgcatcaggaagacggtgccgaatatctccgcctgtcgttcagttttcccggtaaagccgcgataaaagagggtgtgcaaaaactgggacacctgctgaaaaacgggatctagagaagcatgggaagctttcaggcttctcttttttttacccttcagcgcatcgggcgaaaggatttttcagaaaaaccttccaatccatattcagaatagtgtaggatatttatagagctttccaaaaacaggtcatcagatgaccggatcacatactgaggatgaaagaggggttcatcatgaaagtctcattatttgtcacgtgccttgtggatatgtttcagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcaatgaagcggatgattgccgcgtttgaagaagcggagtacgtcgtcagcccgtcaggttcctgtacgacgatgttccgtgaatatccgcatctgtttcaggacgatccgaagtgggccgcaaaagcgcagcagcttgcggacaaaacatatgagttaacggattttatcgtcaacgttctcggggtggaggatgtcggggcggtgctgcataaaaaagcgacagtccatacatcgtgccacatgacgaggctgctcggcgtgtcggaggagccgatgaagcttttgcgccatgtcaaggggctcgagctgaccgcgcttcccggaaaacaccaatgctgcggattcggaggaacattttctgtgaaaatggcgcaaatctctgaacaaatggtggatgaaaaggtcgcctgcgtggaagacacggaggccgaggtgctgatcggggcggattgcggatgtctgatgaatatcggcgggcgtcttgaccgtaaggataaaaacgtcagagtcatgcacatcgcagaagtgctgaacagcagataagacgagaaacaacaagggggtaaaatcatggcgatgaaaatcggtaccgccgcttttaaagagcgggtatcagaaggaatagataatgagtttatgagaggagccgtctccggagcgcaggaacggctcaggataaggaggcttcaggcggccgaggaattgggaaactgggaggattggcgttcacatgcggaagaaatcagacagcatgtgctggacaatcttgatttctatttggaacagctcgccgaaaacgtcgccaacagaggcgggcatgtctttttcgccgaaacggcggaagaagcgtcctcctatatccgcgatgtcatccggcagaaaaacgccaaaaaaatcgtaaaatccaaatccatggtgacagaagaaatcaatatgaacgaagtgcttgaggaagagggctgtgaagtcacagaaacggatctcggcgaatacattctccagattgacgatcacgatccgccgtcacatatcgttgctcccgctcttcacaaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcatcacgggctgcaactttgcaatcgcggataccggatcggtcagtctcgtgacaaacgaaggaaacggccgccttgtgtccgcgctgccgaagacgcagatcaccgtgatgggaatggagcggatcgttccttcattttctgagtttgaagtgcttgtcagcatgctgacgagaagcgcggtcggccagcggcttacaagttacattacggcgctgacgggcccccggcagcaaggagaagctgacgggcctgaggaatttcatctcgtggttgtggataacgggcgttcccgcatactcggcacggaattccaatcggtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcgtgtccggttaaaattccgctgcacgagctgctgctcaagcatcggcagaacattgtggaaaaagagggcaaagcgccgatcagcgaaaaactggcgatgaaagccttcgggctcggctcgtcatccccgtccctttataaactgggatcgaaatgggcgcctgccgccatgacgccgtttacggaggatgacaaaatatcaaaagggccggggccgttaaaagaatggacggcaatacgggacttcccggcgccgcataaatcgagattcagagattggtttaaagaccgggaaaaacaaaagggggaagaatgatgatgaaagggacggttacacatcaggaatcctttctaaaccggatcgccggaagtctgggcagagagcgcaggaaatcaggcgtgtccctgcctgaatggaagtatcagcctcaatatcaaacgcatgcggactgtacggaagacgatcttgtcacgatgctgaaagaccactgcgtcaacattcataccgaactgatcgaaacggatgcagccgggctttacgacgctttgcgcacgcaggtgaaccgctttgaagggggcctgtcatcattccgaacgacagccggtttgaaatgtacggcttgcagacccttatgacagaagagtggccggacgaagggattcccgtttgggaatgggacgcggaacaaggagcgaaaaatattgaaaaagcggaacaagcgaatgtgggcatcacattcagcgagatcacgcttgcggaatcagccaccgtcgttttgtatgcgtcagagcatgccggccgttccgtcagcctgcttccgaccacctatatcgcaatcatcccgaaatcttccattgtgccgagaatgacacaggccagcgatatactgaaacagcagatcagagacggcgtcaccgttccttcctgcatcaactatattaccggaccgagcaactcggccgatatcgaaatggatttggttgtcggcgtccacggacccgttaaagccgcttatatcctcgtgaatgaccgataaaaaaacaaaccccggtttgcggccggggtttgtttttatataaacgcgttaatgatcatgataaaacagatcgcactgacagaaataatcgtttccatcgccgtccatgtcaggaacgtttcttttaccgtcattccgaaatactctttaatgagccagaaaccggagtcattgacatgtgacagaatcaaagagcccgctcccgttgccaaaacgagaagctcgctgctgacgcccggcatgacagatgcaatcggagcaacaatgccggccgccgtcatcatggcgacagtcgctgaacctgtggcgacacggatgaccgccgcgatcgtccagcttaaaagaacgggagagaagcttgagtgcttcgccatgtcagcgatatacgtgccgacgcctgaatcaatcaggacgttgttaaaagcgccgccggctccgatcacaagcagaatggaagcgatcggtcccagacagtcattgctgaattttaaaatgctttccctgtcaaagccctgataaaaaccaaggctgaaaaaggagtaaaccgtggcgatcaaaagcgccgtgacagggtcgccgataaatttaaaagtttcatagagcgtgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaataccgacgattaaagaatacaaaatcgtttttccgacattggcgtgataaatgccgacagccgccatcgccgccgggtggggcggaaccaatccgtgcacgacggaaagtcccgcaaggagcggaatcccgatcgtcactaatgaaaccccggtttcaatcgcaatcgtaaacaaaagcggcacgagcaggacgaagccgacctggaaaaagaccgggatgccgacaataaaagcgacggccatcatcgcccaatgcactttctttttgccgaagcggccgatcagggtgtgggcgatccgctccgcaccgcctgattcagccatcatttttccgagcatcgtaccgagggccagcacgatcgcaagcagagacagcgtattgccgagcccggttttcattgaagtgataatgtccggcagattcatgcccgttgcgaaaccgacaaggatggatgtaatcaaaagactgataaacggatttaatttagcgaccgtaatcaataagagtaaaacgataatagcggcaatgacaataaacagtaacatgaccttttcaccctttctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatggcggtgcgaaattctgatccagtcctgaacatcctcgatccgttccatttcgccaaggctgtgcaaagcgagaacggccgctccgagcgcagaggcttcgtaactttccggaacgaggacttcgcgtcccatcgtatcggacaaaatctgcctccacagcggcgatctcgcaaatcctcccgaagcccgcacgtcttttgcggggcccgccaaatctctcagtgcgacaccgattgaaaagacgctcatgatgacgccttccagcaccgctctgataaaatgctcccgtttatggcggaggctgatgccgaaaaacgttccgcgggcattcgggttccaaaacggcgcgcgctcccctgataaaaacggcagaaacagcaatccctcagagcctgcgggcactttatcagcaatatcaatcattaaatcgtacggatcaatgccgagccgcttcgccgtttcaacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgcttgttccgatcgtaacggccacttcgcctttgccgatcgcgccgactcccaggttggcgagcacgccgtcatttgcgccgataataaacggtgtatccgcatggatgcccatccgtgcagcgatttccggcgcaaggccgcgcagctgatgagtggtcggcacaatgtccgacagctgatcttcccggattccggcaatcctgagcgcttcttcatcccaggaaagcgtatctaatcggaacagtcccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcggatgaatcggcgtacccgttcttttataaatatcaaaaccgttcatctcttttaaaatccgttttgattgctcggcgctgcggttgtccgcccaaatgatgcttttggtcagcaggccgccgttttgatcgacagctatcaatgagtgcatggcggtgctgatgccgattgcaagcagattgtcaggactcagtccggcctttgtgacggcgcccctgatgcttccgatcaccgcttccaaaatgtgctcaggatcctgctcggcccatgccggctttggctgtattaaatcatagtgaaccgaatgcttggctaacactttgcctcttggtccgaacagaacagctttcgtactggtcgtgccgatatccagaccgataacagcttgggtttccttcataatatatcccgcctaatctgattgaataataagatagatttataatgtatgcccttacaaagtcaattataggaataatttttttataaatcaacgatgaagaagaaaaattttttcataaaattgcctcaattcccgctgtatcggctttctctcttttgaaaaaaatatttagaaaacgattacaaacgtttgtgcgcgatcatttttctgatttgctgcaagttggcgagcgttttctcctgccgcagccgggccgtggcgaaatacagtgtatcaatgaccgacagctgggcaagccttgcggacatcgcctccgttctgaaagccgtctcccttgttgatgtatacagcacaacgtcggaaatctgggtgagcggcgacttttggtagcttgtaatgccgatcgtgccggcgccgagcgatttggccgttttgaccgcgtcgagcacgtccttgttgctccccgaatgagaaatgccgatgactgcgctttcaggaccgagaagacccgctgacatcgcctgaaagtgagaatccgtatgcgcgatgcaatttatacccgtacgcataaatttatgatacgcgtcagtggcgatcagcccggaaccgccgtttccgtaaaattcgattctgtctgcgcggtggatcatttctaccgctttttcaacgtcggccggatctaataattgaaaggtatcggtcagaccggaaatgtttgtgcggaaaactttccggatgatgacttcgatatcgtcgtcggggctcatttcttcatgaatgtgctgcaccggctcctgaacgatctcctgagccagcgcgatttttaaatcctgatagccggaaaaaccgagccgcttgcacagcctgaaaatcgtcgcttcagagcttttcgttttttcggccagctgaatgatggaaaggtgaaccacgtctttcggttccttcacgatatggtctgcaatcgctctcaattttggcgacaaacctttgctggccgcctgaatcttcccgatgctgcttgaattcacaggggtcatactataacctccctactcgaatgtaaacgcatacttttatgataaagcaagtttcaatataaggaaaacagaattttaaaattgttttttcaattttgtgtgtaaaaaaagagaaaaagccgccgatgatagaaagtgaggaggcatctgaatgaaaaaagcatggattctcgtcatatcattcggcattgcgcttgcgctgtttttatacgcaaacacaaaggtgaaagcggaaagcatggcgccggaaagcaaagccttgtgtccggatttcagctgaaatttccgaatcaccgggaaggacaatagacggaaaaaattagtattgactttgaaaatagaagactgtatattatgttactatattcagaaaataaaaactcaagagattcatttaacataaaacactgtgaacgggagcagtaagagaatccagtcagaaaaagagagccgcgggttggtgaaacgcggactgattgttctttgaactcgcccggaagtggcagggcggaacggaattgtcggaatattccctatgtcctaacggctgaccttcgttaaaaggtttttaagctggattccggatattcgggatcaacaagagtggtaccgcggctgcctgaggcacgccgtctcttttcctaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcaatcggggccgggctctttaaaggcagcagcacggcgattgatgaagcggggccgtccgtgctgttggcctacctcctcggcggaatcattctgctgtttattatgcaggggctggccgaaatggccgtcagaaacaaacatgcaaggacgttccgtgatttggttcagcagtctctcggttcgtacgctgcatactttttagactggatctattggaaaatgtgggtgctcaatattgccgcggaggcggtcgtagccgccattttcattcaatattggctgccggaatgtccgatatggatactggctttgatcatttccatcgtggtgacggtcgtaaacatgctttctgtgaaactgtttgccgagacggagtactggctcgcgctcattaaaattacggtgattgtcatctttattttatgcggaattctgctattatttttctcattcggcaatcacacggcgccggggctgtctcatttaacggatcacggagggtttttcccgcatggagcggggggcgtcattacggcgatgctcgtcgtgatctactcatacggcggaacggaaatcatcggcgtcacgctggcggagacaaaaaaccccgaaaaggtgattccgaaagctgtccgaagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaactcgggactgtacggatcatcccgcgtcttatttacgcaggcttctgacggccgggtgccgaaaatcttttcaaaactatcgaagaaaaaggttcctgtctatgcgattctgacttgtacgtcatttttatatgtaggcgtcctgatttctttattcgcaggaagccggacgtttaattatttgatgggttccctcggctataccgtgctgttcatctggctgattatcggattcgcccatttaaaatcaagaaaacattcaacagaacagccggcttattacgtcaaatggttcccgtacacgacatggttcgcggtgcttgcgcttttggccatcctgatcggcgtaattgcgacgacgtccatcgtcatcacatgcatcactgcggccatctacctgctcattacggctgcgtatctcgtgaaagggagacgtcaataaataaaaaaactcttgccccgcggcaagagtttttttaatgaacggcctttttttctgcggccagagcaggtgttttcagtttcttcggtgttatattcacaaaacaaatgcttgtgacgatcagaagcagtccggctaaaaggctgacggtcagcggctcatgcagaaatatcgagctgacgacaatggatatgagcgggatcaggaaggtgtaagaggcaaccttgcttgcttcccctgaaccgacaagcgtaaaaaaggcgagccagccgagtgcgatgacaaataccgaaatgaacagaaggctgagaatgaacggagttttccattgaatcgctgaaaagctttctgaaaaatggccggagctgacaagcagcacgccgccgatcagaagctgaagagcgaccatccagatagagtccgcgcgtccgcccgttcttttcacatataccgtgccgagcgcccagctgaccgcggagcccagagccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaacaccggctggaaaaacacgatggctgaaaataagccggcatgcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcgagcgcggcttttgtcagcggccagttaattccccataccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacacagcccgccgtaagccatgccatctcggcgcttgagtcagagctcggcatcaagctgatcatccgcgagcgccgcaacggcgtaaggctcacggacacgggcggaaaaattctcgttcatatcagagaggtgctcaaaggcatagaaaaagccgagcagctggcggccgcggaaagagggcttgaacagggaacgattcacatcggcacatttccggccgcttccgcttatttcattccaaaactgatcagcgtgtttaaaaaacggtatccgaaacttgagttggtgctttatgaaggaacggttaacgaagtaaaggaatggctccgctcccgggtaatagatgtggggatcactctttttcctacggaagacatggaatatctgccgctgaaaaaagataaaatggccgtcgtgcttagaaatgatcatccgctttgcagctgtgagtcaattactctgaaagatcttgaccgccagccgatgatcatctgtgacggaggatacgaatcaccgtttattgatatgtttaaggaggcagggtctgtgctgactgccgcattcactgtttacaacgtcaatacgtccatcagcatgatcaaagaggggctgggaattgcgatattatcacaaatgtctatgtccggaatatcactgccggaaaatgtcgtgacaagggaactcaatcaggcggtgtaccgtgatgttctgcttgccgttccttctgtaaaagaggcttcattggcggcaaaactttttattcaaatcgcgcaggagctcacaaagaatgaataaaaaggccctaatgatcttagggccctgaatcttatcggttaattttaaaagagtttgtcgtattgacaagttttgaaccgctgaacgtagctttgacacgataataacctgtcttgcatccttttaaagagaatgacttagtcacccttactgagaaagaaaaggttgtttttttgcaagtcgtccatttctttccggactttcgctgtaagtataggtttcctttaaaggttcgatctgacggatacgctgtactgagagtaaaatcgacacttttcgcttttttcgtgtagtaggaggcatcggtaaatccgcttacatttaaatgctgctgagtgccggaataaaagtctgcggcatatgccttatcggtgtttccggtaaagaagattgctgccagtaaagctgttgtgagtgccattaagatttttttacgcatatagactatgacttccttcctattcaatatatgacatatgttaacattattggttctgttctttcaatgatatcttttcatttttatatcattctaggctcttcatatctgaatgtaatagattcattcatacagagttcactagtgacgaccgctgactgattgttcgaagatcatcgaatcaaattgtttaactcacgggaaaagctgtggtaaggtgtgtggtagagaccttgtttaagatctgcttacactaaaccataaaggagaaaacgatggctgaacatacattgaaagatactgcgttttccgtattgaatttatcgccggtcgtacaggggggaacggttgctgaatcgttccgcaacagcatggatttagcgcaccgcgccgaggagtggggctataaccgctattggctggcggagcatcataatatagaaggtgtcgccagctcggcaacggcggtgctgatcggccacatcgccggcggcacgaaaaaaatccgcgtcggttctgggggcattatgctgccgaatcattcgtcacttataatcgcggagcaattcggaacccttgaaacgttatatccggggcggattgacctcggactcgggcgtgcgccgggtaccgaccaattaacggcgagggccttaagaagaaacataaacagcggggaggatttcccggagcagcttgaagaattgagaaattacttcaaaccctcaggcaatgtgcgcaatcaagtccgcgccattccgggcgaagggctggacgtgccgatctggcttttgggatcgagcggcttcagcgcgcgtcttgcgggagagctcgggcttccgttcgcctttgcggctcacttctcaccgaaaaacaccgtgcccgcccttgagctgtaccgaagctccttccgtccgtcagacgtactggatcaaccgtacgcgatggtcggcgtcaccgtcattgccgccgatacggatgaaaaggcggagcatctggcgacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggaaaagctggaaagcttcatccggacaacacaggcggatgaaatcatggtgaattcagaaagctttgagcatgccgacagaatgagatcatttgagatcatcgccgaattaaaaaacagctgagcaaaaaaagcaatgtgccgcgcacattgctttttttattcgccgatccgcctgacggaatttcggatgacgagttccggttcatacacgacgtcatccttcttcggttttttatgctctaagcagccgatgacgtattttgccgccgctttccccataatggatttcggatgcttgacagaggtgagcttcacctcggaaatctgggcgaaatgtgaatcatcatagcccatgattgacacgtcatcaggcacctttaagccgaattctctgagaagattaatcgtcttcagcgcaatttcatcattataacaaagaatggccgtcgggtatgatccgctgttttgctcaagggtatgcttaattttttgaagaagcacggtttctttttcttcagtcgtgtaagtcacgatcatgtccggagacggaaaaatcccgcgctcccggtgcgcctgaagatagccgttcatccgtttgacgccctgcgtgtcatccgctttaaagattcccataatgtgcgtgtggccgagggacatgacgtattcgcaagccatcatgccgcctttgacatcattgacggaaaagctcggtgcggccagctccgcataagaggcgttaatcatggcaaacggaatgccgtttttctccaggttgagatagtagccgatgttgggcgtctgcagcgcgcttttcgtaggctcgacaatcagcccgtctatatttttggacagcaggttttcaaggccccgccgctcactttctgtattgttgttggtgctcgtcagcagcatggaatagccctgttcgcttaaataagattcaattcccctgatgatgctcgggaaaatatagtctgatatgtacgttgtaatgacaccgatcgttttgtttgaatgcatggctgatttcgccgtgcgtgaagcgacaaaggtgcctccgccctgaacgctgtacagcaacccctgcgagaccaaatctccgatcgcctttctgatggtatggcggctgaccccgaactgctgcatcagctcattttccgtaggcagcttttcgtccggctgtatttttccctgattcagccatgaacaaatttcttcttttacttgagcatatttcggtagcatatcaattcctccaaaatgtatacggacaaattccagtataacatagtaagccctttcatcaagctgtaaaaataattgacagattgtgaaaaactgcttattctttatttgtacgtactaattttccttatttttagataaaattctttataagtacgtacaaatgtggcggttctgaagaaaacaaagcaactcaagcgccgcactttgttttgtaagcgtttttattctattattcgcgggagggtaaaattcatgaagaatcacccggcaccaattggctcaaatgtacctgtcactcggcagcattcgaagtggtttgtcattctcatctcatgcgcggccggactgggagggcttttgtacggttatgatacggcggtgatttccggcgccatcggtttcctgaaagatttgtaccgcttaagtccttttatggaagggctcgtgatttcaagtattatgatcggcggtgttttcggcgtcggaatttccggatttttaagtgaccggttcggacggagaaagatattgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggccatacgcggcagtctttcctcactgtatcagctgtttacgatattagggatctccggcacttattttattaaccttgccgtccagcagtccggctcgtatgaatgggggtgcacaccggctggcggtggatgctcgcttacggcatgattccgtccgtcatcttttttatcgtgctgcttatcgtgccggaaagtccgcgctggcttgcgaaagcggggcgccggaatgaagccctcaccgtgctgacgcgcattaatggcgagcagaccgcgaaagaagaaatcaaacaaatcgaaacgtctttacaattagaaaaaatgggttcattgtctcagctgtttaaaccggggctgagaaaagcgcttgtgatcgggattctgctggctttattcaatcaggtcatcggcatgaacgcaattacgtattacgggccggaaattttcaaaatgatgggcttcggacaaaatgcggggtttatcacgacatgcatcgtcggtgtcgttgaagtgattttcaccattatcgcggttcttttagtcgataaggtaggccggaaaaagctgatgggggtcggatctgcctttatggcgctgttcatgatcttaatcggggcatccttttattttcagctggcgagcggtccggctttagtcgtcatcatattgggattcgtcgccgctttctgcgtatcagtcgggccgattacgtggatcatgatttcggaaatctttccgaaccacctccgcgcacgcgccgccggtattgcgacgatattcttatgggggccaactgggcgatcggccagttcgtgccgatgatgatcagcgggttggggctcgcgtacaccttctggatattcgccgtcattaatattctctgtttcttgtttgtcgtgacgatctgccccgagacgaaaaataaatcattagaagaaatagaaaaactctggataaaatgaaagcgttttacggcaaaagtccgctgcggcgggcttttgtctgtcaccttcattccgtttctgtatataatgactgtatcaaggagatactggtaaatcctgcgaagaatgtcgaggaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttacagaaccgatcggccgcagaagtcttgcagccagtctcggattgaccgagcgcgttctcagaagcgaggttcagttcttaaaagaacaaaatctcatcgatattaaaacaaacggcatgacaatgacggaagagggctattcactgctttcgattctggaagatacgatgaaggatgttttaggattgacgcttttggaaaagacattaaaagagcggctcaatctgaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgccggattcaaaaaaccgcgagctcctgtttgtgcccgcaagaggcggtttaggcgaagatgtgaaaaaccaggcgaacaccatatgcgcgcatatggcggaaaaggcttcaggcacttaccggcttttgttcgttcccggccagctgtcacaaggcgcctactcatctattattgaagagccttccgtaaaagaggtgcttcacacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagctcgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcagttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaacttaacaaagacgtaacggctgaagacgtaaacgcagctcttaaagaagcggctgaaggcgatcttaaaggaatcctcggctacagcgaagagccattagtatccggagactacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgagctgcgcttccaacaatcaaacaccttgcagaccaaggcgcgaaagtccttcttgcgagccacttaggccgcccgaaaggcgaagtggttgaggagcttcgtttaactcctgtcgctgcacgcttaggcgaactgctcggaaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacctgatcatcggcggaggtcttgcttacacattcgtaaaagcgcttggctatgaagtcggtaaatctcttcttgaagaagataaaatcgaacttgcaaaatcattcatggaccgcgcgaaagaaaaaggcgttaaattctatatgccggaagacgttctcgttgctgatgatttctctaacgatgcaaacgttcaaatcgtgccgatctctgagatcccaagtgatttagaagcgatcgacatcggaacgaaaacccgcgaaacgtacgctgaagttatcaaaaacagcaaacttgtcgtatggaacggacctatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccgggtgtagctgcgctgaacgataaataaaaactgctataaggaagtggaacagatgagaaaaccaattatagccggtaactggaaaatgaacaaaacactcggcgaagctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatgatcttgttgccgatcaagtgaaaaaagggcttgcgggtctttctgaagagcaagttgctgcttccgttattgcgtacgagccaatctgggcaatcggaacaggcaaatcttctacagcgaaagatgcaaacgacgtctgcgcgcatatccgtaaagtcgttgctgaaagcttcagtcaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttaaatatcggcgccggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgacggaggcgtacacagtcacatcaatcatttattcgcgctgctgaaacttgcgaaaagtgaaggactgacgaaggtgtatattcacggtttcctcgacggccgcgatgtaggtccgcaaacggcgaaaacttacattcagcagctgaatgagcagatcgaagaaatcggtgtcggcgaaatcgccagcatttccggacgctactactccatggaccgcgacaaacgctgggaccgtgtggaaaaagcgtaccgcgcaatggcttacggcgaaggcccgtcttaccgcagcgcgatggatgtagtcgacgattcttatgcgaacggcattcatgatgaattcgtcattccgtccgtcatcacaaaagaaaacggtgaacccattgcgaaaattcatgacggcgattctgtgattttctataatttcagaccagaccgcgccatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtcggtgaagtattagcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccattatcgctaaaggcggtcatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgaccggaacatctttaattcaaaaataagcgtaaatcaaaaggagagacaaactcatgccatacattgttgatgtttatgcacgcgaagtccttgactcccgcggcaacccgacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcattgctccagagcttctcggctttgacgtaactgaacaaaacgcaatcgatcagcttttaatcgagcttgacggtactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaacgtagacattcaagaattcatgattatgcctgtaggcgcgcctaacttccgtgaagcgcttcgcatgggcgctcaaatcttccacagcctgaaatcagttctttctgctaaaggaatgaacacagctgtaggtgacgaaggcggattcgctccgaaccttggttctaacgaagaagcgcttcaaacaatcgttgaagcaatcgaaaaagccggcttcaaacctggcgaagaagtgaagcttgctatggatgctgcatcttctgagttctacaacaaagaagacggtaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggtgacgaccttttcgttacaaacacgaaaaagcttgctgaaggtatcaaaaacggcgtaggcaactctatcctgatcaaagtaaaccaaatcggtacattgactgaaacattcgatgcgatcgaaatggcgaaacgcgcaggctacactgccgttatctctcaccgttccggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaatatcacggtatcaactctttctataacttaaataagtaatgtaatggacgccgggagaatatctcccggcgtttttttatggtcccgggcttttccctcctttttcatcatcttcatttggtcaataatattcatttttcccctttttaaaggaatcagtgttcttcaatcgaaagggaagaggtgttaataagaggagggattatgatgaaattttcatttatgtcagccgcggtggcagcaagcgtcatatggggcgcgtctgccgggccgctgtccgaaactcatgcttattcaactgtgaccgcgccggtttttgatgctgatgaggcattggacactatgcatgatctgagtgaaaccatcggtccgcgggaaaccggaactgcgaaagaaaaggaagcggctgaatacatatcgaatcgtctgcgggctcagggcgccagtgtcaaagtacagtcatttccattgaaaaagtacttttcaggttcagtcacagcgggagatcatgaattcccgctccgctccgctgatcaatccgctgttgaaaaagagctcaaaatagaaggcgggatttttgacggcggctgcggatcacgcaatgacgtaacaggagccgaaggaaagattgcagtgatacgcgaaggaaagatccctgtttctcaaaagatcaaacatgccgaacaagcgggagccaaagcagtcattatttataatcagacaacaaaaccgctcgccgtccgtccgcataccgataaaggaatcacgataccggcggcgggtatgaaaaaagaagacggtgaagcattgcttcaggaaaagaaggcagtcattcaatttaaaaactataaaaaccgcacctcacaaaatattataggaacgcgcaaagcggcacaggccaactcttctgatgctgatattatttatgtcacagcgcattatgacagcgtaaaaggcgcgcccggagcggatgataacgcctcaggcacatctgccgttctggaaatcagcaagcaactcaaacatataccgaaagacaaagagatccgctttatcctgttcggtgcagaagaattatggtctgcgggttcatcttattacgtcagtacactcacgaacaatgaaagaaagcacagccgggccaattttaatgccgatatgattgcgactgactgggaagaagcgagtcaaatgtgtgtcacgactcctgacggcaggaaaaacccgagtgtccggtatgctgaaaaagccgctgaaaaatcccggttggtcaagccaaacctgattcagctcggttactcagaccatgtctctttttatgaagcggggattccgtcggctaactggatttggctcagccccgatacacaggagccggggccctggtaccacaccgaaaatgataatatgaaacacatcagcaaagaacggctagagaaagctggagcactcgtttccgcggcagtaactgaggcaatgaaggaataaaaaacaggcttcggcctgtttttttatattattttctgtatattctatcaattaagggagattttctcactcgttaccagatatataccatttaacaggattttattttacaaataaaagaaaaataaatagataatacctaattcacaaaaggatgtaaaactcatttatcaaattttaacttttgttataattgcgatatcgatcgatatttgttttaaattgtaaaaaacaatactcttttctatctattagggggcgaaaaatgaatactgtcacaaaagaagccagcaaccttggtcaaaaacggctgttacatctgattgaaacgaagcaggcgatagtaggcgtgttaggcatgggatatgtgggatttcctcttgcgctggaatgtgtcgataaaggatacaatgtgatcggatttgacaaaaacagtgaaaaggtttccttgttagccgccggaagcagccatattcaagatatagaggacggcagactgaactcggctttacaaacaaaacgctttcaaatcagtgccgacatgtcgctcatccaaaaatgcgacatcattgtgatatgtgtgccgacacccctgaacaaaaaagacaagatccccgatttaacctacatcgacagtgcagttgacagcatgatcgcttatggaaggcagcatcagcttttaattttagaaagcaccacctatcccggaacaacgaaaaaaaagattgccgacagaatggcatcaagccgcggcatgaaaataggaacagacttttttacggcttattctccggaaagaatcgatccgggcaacaggcaatatgaagtttcagatattcctaaagtagtcggcggaaccacacagacttgcacagaacttgcctcagcgttttacaacaccattgttacaagcattcacccggtcacctcacccgaagtagctgaaacagctaaactcctagagaatacttatcgttatgtcaatatagctcttatcaatgaaatggcgcttaattgccgtgaacttgatattgatatatgggaagtcatctgcgcggcggacacgaagccgttcggctttcaaaaatttatccctggccccggagtcggaggccattgtatcccgattgatcctttttacttcaaatggatcgcgaatgaaaaagggctgcagacaaaattaattgatctggcggacgaaatcaattctaacatgccgatttctgtctctgactatgctttgaaactggcgggcaaagacaaatgcagcatcttaataataggggccgcttataaaaaaaatacaaatgacccgcgtgaatcctcagtgtttacgataatggaagaattgatggacaagggatgcgcgattgattatcatgatccgtttatcagcgagatccgcttgaatgacggaagccgcaaacaatctgtccctttcacaaaagaacaaatcaatcagtacgacgtcatcatcattcatacagatcacgatgtaatcgactacagtattttgaaggatgcctcaccgattatctttgacacaagaaatgtatgcagggaaaaatcagccgacaattgcagagttgtcactttataggagggaacggtcattagtaatcgatttatctcttttcacagacctgatatgacaaacgaagaaatcgcaagcgtaaccgaaacgattcagtcgggctggatttcgaaaggcccgaaggtaatcgattttgaaaaaaagctgggagaatgtattggagccgaacacgtcatcagctgtaattcaggaaccgctgcattacacatggctttattggcgctcggtgtgggagaaggcgatgaagtcatcgtgccgagcttcacgttctgttccagcgtcaatgtcatcctgcacgccggagccgttcctgtgtttgcggatatatgcgagaaaagtctatgtgccgatcctgaagatgtcaggaagaaaataacgccgcgcacaaaagcggtaattgcggttcattttgccggctatccggctgatctggaaaacttgcagtccatttgtaaagaaaacggattgtatctgattgaagacgccgctcatgcgctcggtacaaaatataacggaagcatgatcggcactcacggcgatgccgtgtgcttcagcttttatgccaccaaaaatattacaacgggggaaggcggagccctcgtcatgaaagacgaacaggccgcagaaagagcgaggctgtacggctggcacggcatcacaaaaaatgcctggaaccggtacggtgaaaaaggcagctggagatacgacgtgttactgccgggctttaaatataatatgacggatattcaggccgcgctcggtctggttcaattgaagcgcgcaaacgaaattcaagaaaaacgggcacagatcgctcaattttatgtacgtgaactgtcgggccaatctgacaaagcagcgcttccgctttctgacattccgaacggcataacgcactcatggcatttatttattttgcggatccgagagaacggcggcatggacagagatctgtttattgagaaaatgaaagaaaaacagatcgggctgagcgtgcactttattcccgtgcatatgcatccttactatcaaaaacattttccggccgagctgccggttactgaacgtgttttccgggagatcgtgtcactgcctctttacagccagttatcagatgaggattgcagctatattgtcaagtctataaaagaagttttgactatcagccaggaggtaggatcatgaaacatattgcgattatcggaggagccggttttatcggaagcgaattggcggcattattacaggctaaaggttatcacaccattattgcagaccaaaaggagccggcttttgacactgaataccgccaaacggatatccttgatcggacgtccctccgcgaatcactgcggggagcggatgcggttgtccatttggcggcaatggtcggtgtagacagctgccgaagcaatgaagaagacgtcatacgggttaattttgaaggaacgaaaaatgtcaccgaggtatgcggtgaattgggaatcagaacacttcttttctcatcgagctcagaagtattcggagattcacctgattttccttataccgagacaagcagaaagcttccgaaatcggcttacggaaaagccaaactgcaatcagaggaatatttgagagaacaggcttccgacaagcttcatattcgggtcgtccggtactttaatgtatacgggccgaaacagcgcgaggattttgtcatcaacaagtttttcagcctggccgagaatggctctgagctgcctctttacggggacggcggacaaatacgctgcttcagctacatcagtgatatcgtcaccggaacttatctcgcgctcattcatgaaggagccgtctttgaagactttaatatcgggaacgaccagccgatcacgataaaagaactggctgaaaaagtcaatgtgctctctggcagagagaaggataactatctgtttaaaaagctgggcgaagacggcgtgaggggaaaagacatcgagatttttaaacgggcgccgtcaatcgagaaggcgaaacgtttactcggttacgatccaaaagtaagtctgaatgaaggcctggagatcataaaagatgaaagacaaaagcacaaactttcactttcctgaaaacccggaagtagtcaaatatcccgtttatcccggacagctttccgtcagggaccgtctgcgcgcggtgaagcacttgcttactggcggacaaagcggactgactgaaaaactggaaaaacggtacggaaaaggggttgtgctgacctccagcggcagtgcggcactggtgctcgccttaacttattcgggagccgggccggggaaagaagtgattttctcatccttcagctgcccgaatgtcattgatgccgtattgcaatccggtgcaacgcctgtttttgcgcagctggatgagcatctttctttatcgtttgaggatgtcaaaaaaagagcgacgcggcagacgtgtgcggttatcctcacgcacgtatacggccggagagaaaataccgccatcattgactgggcgaaggaacacggtatttttgtcattgatgatgccgctcaagccatgtttacaaaacaagcggatacatatgccggcggtctgggcgatttcggtgttttaagcttcggcccgtcaaaaccgcttgcgagtatcggaggcggcgcgttaatcgcgccgaaagaatggcttcggcaaaaagcaaatttcccgatggaacagcgcagccaagtggcagctgactatcgaatttatatcagaaatcaaagaatacaggctgttatgaaacggaaacggcatcatcccgtttcatatatttataggaaagcgggcatcatgccttccatgaaagccactaagctcgaagctctgccggataaaccggctgttgtaccggtgcttcgcatgcatccggcaagggaagccattattgaagatcagctttcacttatggatcagcttgtaacagcttcgctccgaaacttacaagcggcgggagaaatctttataaaggcggaagagacgtacggcataaagatgatccagccccaagaaggagaacatctgaattatttaacgattgtattcccccgggatgaagagcggtacgggtgttccgtttatttagctgaaagaggcatccaaacatgctggaactatcttcccctcggacgtattccgatttatgaaacatatgcggcggaagaaggggaagatccgctttggaaaagagttctttctctgccgtttaaacctcctcttcaaaaggagcaagtcagatatatagccgaatccgttttatcatattgtgagcaaaagaataagactgaatagtggtgataacaatgcaaaaaacagcagtatgcacgagccgccaggcatgggatcgggccgctgacatgtatcaggcggggttgtttcaaagctatgattggggaattctcatggaagagcttcccggcacgtcatttcaccctgtcagactgacaacggacggaggacaggtcatctatcttccgctttttgaacagaagggcgtattatccggcaatatgatcggatacggcggcgttatttcagatcgccccatctcatttgaatggcttcaaagtgaaatcgaggccatattcggccggaacatatcccggatgctgctgccgtacggtcagacttcttttacagaagaaatcggggaagggtggacggaaaaggcgacacggattcttacgcttccggacacgtttgacgaactttggacgggcatttccggaaaagcccggacggcagtcagatacgctgaaaaagagaatattgtcaccaggctgatcgggcgacaagaacttgaatcattttacgacctctacaaggagcatacggcggcaatcggcgctgcttatgtgctgagccaaggatttttccaaaaactgcttgacacgtttggggaccggatgttttgggtcggagcatatcaggatgagacgctgatcagcagcagtatttttctctatgaccgctctcatttctattattggcagaatgtaaacagcctggcgggaaaaaaagcgcaggcctcttacttgttgatgcgtgacgctttgcaattcgccatttgccgcaagcttcaatgggctgattttggctattcacacagtaaagaaatcgcaagaccgaaacgatattggggagctgaagaaaaacaatgccgactttttacgaaaccggaatgaaaacaataagcggccatcaatccagttatctgccgtggtacggtttttttgaaaaaatgtataagtcggatctgtttgccattcatgacacggctcaatttgagaaaaaagggtttctgaaccgcaacagaatcaaaacgccgcagggccccagatggctgacggtgcctttgcagatgaaacaatataaagacatagagcttcggcatatgaaaatcgaccagacacaggattggcggaaaaaacattggatggcgattaagatgaactatgcgaaagctccctattttgagcggtaccagcatttttttcaagatgtctatcagagggagtgggaatatctccatgatttgaatatgcacatcattgaatttttccgaaaagagctccgaatcgaaacgccgctctgttatgtctctgagcttgaatgccggaaggagaaaaaaagcgattttgttttagcgctttgtcaggagctgggggcggatcgttattattcaggcagtcagggttccgactatttaatagaaagcgattttgaaagaaacggaattgtcattgagtatcagcagatccggcattttgactatcctcaattattcggggagcatatccctcacctctccatgcttgatatgctgatgaactgcggagcggatacagctgaaatgttagttaaaggagggcaatatgatgaaagtaatggtatttgcagcgcatcccgacgatgaaattatcggcgtcggcggcacgctcgccaaacatgtccgccaaggtgacagcgtgtcggcagtcattatggcggaaggcaagtcatcaagaaaaacggattatgagaagcctgaagagtctgttatgcagcattctgctcaagaaacggaacaagcgctcagcactttgggcatccatgattttgtcaggctgaaccttcctgataacagaatggattcaatggatttgctggatgtcgtgaaggaagcggagaaacaaatcaatcgttttcagcctgacattgtgtatacccagtacggcggtgacattaatattgaccactccgtcgtattcagagcggtcatgaccgcaacccgtccgcttcccggccatacggtaaaacgggtttttgcctatgaaacattgtcttcgacggaatggaattactgtcagaaggatcagtttcatgccaatttcttcgttaatattgaagacgagcttgaaacaaaattgaaatcgatggcgtgttacggctccgagctcagagacttccctcatccccgctctttgcaggcaatcgaacataatgcccgtgtatggggagcaaaatcgggtttttccgctgcggaagcgtttatgcttgtgagaggaacatggtgactgtcctatgattgctcaaattccgtttttcggacttgatccgaagcaaatcgatgagaaatgggtggaagcgggatacggtctggaagcgaatatttttgacggccgctcctttagtgaagcggattatctcaaaacattcaatcagacgctggaatatgcaaaacagcttgatccttcattattgacgctgcatttcccgacagatcatgccgattatgtgcatgaagatcacatcaaaaaacagctttatcactttgcggagctcgctgtgaaatacggcgccaaaggcataaccgttcatgcgaatcaatttatgacggttgaggaatttcaagtgtatgacctggaaggaaaccgtaaaaaaatcattgagtttttcgcagagtttgatgagcagctgaaagggacggacatttggatcggtgtggaaaaccttccgatcatcgggaatctgggagaggattttgatccgattttcatttatcctgaggattttacagagctggttcagctggatctgaagcatgtcggtattacgtgggatctgtgccattgggcgattacctatcagactcacttgtcttccgcgcttatgttcagaaatgaccagctgagatacccggatttctttcagtttctctcgataaaagagagcattaaacattatcacttcagctcatttcgccagcttgcgttcccgcatggcggcgtccgctgttttgagggccgccatccgagtgaagggacgatcgctgaggagctgctgagacgggctgccgatactttgcaggagctttatcggaatcaagataccggcattgtatttgaggtgatggaagaggattatacggaaagacgggaatcatggagaacgctggaatggttcggcggtgtttctgatgccgaggatcaaaaaagggcctgatatgacatatcgaacaccgaactatgcaaagctttggtgtgcgcaggtgttttcttcagcggcggacggtatctggcttattgcactgccgctgttagtgctggaattgaccggcagtaaaattcttgtcggcgttatttcttttatcgaactcgtgccgttgacatttggcgtgctggcgggaccgctgattgatttattccgaaaaaagtcgatcttgtatttgtgcaatacgggccgggccgtcatcatgatcctcttggcggtgctcagcgcgaacgatttattaaccgtgtggatagcaggggtgtgcgccttttgtctatctctgcaatcgatgctgtttgcgccggcgaaagtcgcgatcattccgctgctcgtccgcaaacagcatcttgatcaggcgacatctctgatcaatacgagtgacttgatcggactcatcgtcggaaaactgatcagcggaatcatgattgcggctattccgttcgggctgctgtttgccataaacggaactgctttttttatctccgcggcatttatcgcgttcattcgtatttcagaacagcccaatgaaaaaagcaacggggctgaagatgtaaaagccggctacagaatgctgaaaggaaatgcggcatggctgacatcggtcggatactttttcgtcgtaaatctcgtcattgccggtcttatttcagtaatggggccgattcttgctgtggaacgttttcagcagaactattctgtatggtttgccgtcatgtattcaatgtttcaggcggggatgcttttgggcaatctggccgtatttttcaaatggaatacaaaacgcttgaaccggctgtatccgcggacgttaacggcagcgggactgctcattttggtgctgttttttccgcttcacgggtttgagtgcatcattttcctggtgcttggcatcatcatctcgtatattgatgtgcaaacggtgctgtatttccaaaagacggttccggccgcatatttcggaagggtttttgcactgattttttccattgtcaaaatgggtgaaccgctgtctgccgctgtctacacagggcttctgctgttgatgaatgcggattatatttttgcggcggtcggactgacccttacgatcgtttttgctgttttttcagtcagacaagggagtcaaagaaattcagagaaacaagcggatcaatccgtctgaatggtaaacgaaggtgcgccggtatcagccggcgccctttttatcataaatccaaataaagccgtatcatatccaggcattgaatgccgttttcaaaaatgtcttcatcataatgtctgataaaaaaatcatggtcgacagcctgaatgcggaatccgcatttttgatagagtgacagctgatgaatactggaatttccggtgccgatttcaatcgtgtcagctcccgattgtctcgctttttcaatggcatcttgcaccagctgttttccgaatcccctgttctgcagcgattcttttaccgcgatgtttacgatttctatcgttttaggccttgtttgcaataaaacgtaaacccctgcaagctcgtctgacgtccaagccgtatagcattctcctcttacaagataatcatcgacaatctctttcgacggatcggccagcagcaatagttcatacagcgcttcatccggatccgcggcttttcggatgctcagtttttgcatgtccgtttctcctcctccgttatgatcgacagctatttttcaaaataactccaaaatcattctactttattataaaatatgaaacataggaaaagttatacaagttttgtagattgaataggaggaaagtcatgtttttttgtaagtattgcggccgacagaacaacgaagaggcgcatttctgtaaagaatgcggaaaaccgatcgggaaaggaagccggcttgaacggcaggcggctgtaagagcggctgaacctgcttcacaaatgagaaagccgatccctaaaaaaacgctcttcatatggggcggcatagccgcagcgctgatcttattgattgccgcatataaaaccggagcctggctgacatctgaaaaaaggctcacggatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggaaacgcttcgcggcaattcatcagaaaaagatgcggtatacgtcaaaaaagagggtaaaacccttcttttgtttgaccattacgaactgaaagtcgatccggtttatttccgcgtcaccagcaattataaaggcgccgatctttatatcaacagcgagaaaacagggacggtcaaaaaagccgatgaaacccaaatcttcggcccgtatgcacccggtgtctacacggcggaagccaagcttaaaaatgacacggttgacgttgtcaaaaagcaagaggcagaggcggccggcagccggaatgttgattttgatctgccgttagacgccgaggatgtgacgttcactccggcagacagcttcaaaagcgcgaaaggcgatctgctgataaacggcaagtccgtccataaagatccgtttacatccgttacatacggtccgctcttaactgacggttccatgacagccgccgtggaggctgattttccttggggaaaaatgaaaactgccgatgttccgatcaacggtactgatatggaattaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaagatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcattatgtactctcatatgatacaaaacataaaaaatgggtttttgaaaaagctgatccagcctcagattcttctgggacaaatgtaaaaaaaataaaaaacgaccagccgaaaacctatacatccgcatgggcatcttccaaaggaaatacagcttcaggcagcgtgacaaacgagcaagtcacatcgtttatgactgattacctgacaaatcaatcaagcgccgtcagccttaacaattttgccatcatggcgggcaatttagaagagggaagccctttgtatgctgatcagcagaaactggtcaaaaaactgtacagcgaggggacgactgaagtatttaataaagtgaatgtcaaaagcttttcacagaaaggctctcatctgacgattcatacgtacgaggagttttatattacgaaagccggcggcagtccgaagctcagaacatacaattggacgtatggcggcgttgtcaaagacggaagaatttatttaacatccattcaataaaaaaacccccgcgccaatcaggcggcgggggtttccgtttttaaaagaagaaataattcatgagttctttcatataatgcttgatcgtgaattgaaacgttacgcaaatgatcaaatagatgacgataacagaataaatgatatccgccttagcagtgagctgatgctgatagctcgccagcatgagcggaggcacggcaaacgccgctcctaaaagaccgacagccagaatggtaaagcaaacggttgtatgaagcagcataaaaatgagggcaagaagcaaaatagctgtaaacggaatcaaaaatgctccgaatctggacagcgaatctttaaatgacacctgcgcgccgccggccttcaaagcgataaaaatcaagagatacaggcagaaaacgcataatgcaaaggtaagcgccggtttgatcacaaccgcggtaaaactgacgtcacgaaagccgtctgataagagaatataaaacataatcggcgtcaccaggcagaaaagcaccatgttgatgatgctgctgacaagctgttcgccgcctgtcgttttacatgtttgatacggtctctttaacacatcaagcacgaataaggcaaattgctttgaagcctgcttagccgcggcgccggcctgagcggcctgaccctgtgtttggcctgcgcctccctgcccgggctggggcgcaccgcatttttcacaaaattttccgccatcagtatgatggccgcattgagaacaatacattctaaaactccttttacaagtaatatagggattttgttcaatatttacattataaaagaaaataggacggatgtaacggagttttctaaagatatataaatcaccttctctatgaattgataatagagaaaaagtacccattatggtagaattttattggagctgatagatatcatgtctctcggcgcattgattcagagtgaaaaaggaaattaacgcatgctaaaaaaattgaaaatgctttatcggctgttgaaattcggaaaaggcttatggagatagcaaacagaaaaaaaccgtccttacaaggacggtttttttctgttttccggatcgtccggctgaggttataaaaagcagaccccggggtaaaaatcatgcataagaaacagcggagaacaaaacataactcaataacggcaagtcataaggaggtacgcatgttttcattcatcattcatgtcttcatttcactgtttgcagtctccaatcccatcggaaacgtgccgatttttctttcactgacggaaggatacccggagaaagaacggacagcgatcgcacgcaaggcttccgtgctgtcgtttatcatcttggctgcttttttaattttcggccatctgatctttaaactgttcgacattaacattcatgccttgcgtatcgcgggcggcatttttattttcggcatcgcttataatcttctgaacgcgaagaaatctcatgtacagtctctccatcatgaagagaaaggggagagcaaggagaaagccgatatatccgtgacgcctttgtcgattccgattatcgccggacccggtacgatcgcgacggtgatgagtctgtcggccggccatggcggcatcatccattacatcagcgtgcttatcggcattgcggccgtcatcgcgatgacgttcatcttctttcactattcttctttcatcagcaataagctcgggaaaaccgaaatgaacgtcattacccgactgatggggctgattttggcggtggtggcgatcggcatgatcggcgccggtctgaaaggcatgttcccgatattggtttcctgacttaaaaaagcagcgcccggttatcttcgggggctgcttttttctattttcggcacatgctgaaacacttcttcactctcaaaaaattctatcaaacggctcagccagtcataataatggagccaatccgtcagttcatccaaaagctgacgggctttttcttcaatatcgggactgagattttccgattccagaagctcagtcagctcgcggttcagctttttatagagcattttgtttttgctgaccgcctttgtccaatttgccgtaaacagggagataaacgtctggtaataatcacgctccacgtcgtaaaggtctttgcgaacgcctttttcaaacactttttccgccagattggcatcagtcatttcacggaccacctggctcatcctcgttttgctcatcccggttgcctctgacagctcatttaacgtcatcggcttgcggttcatataaataataccgagcacacgaccaagtgtggccggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaactttttattttacaaatttcatcttataataaagattatacttttcagaaaaataacggaacccttcggaggtgcacggattgctgagattagaaaatgtatcgaaagtctataaaggcggaaaaaaagctgtcaacagcattgatttaaatatcgaaaaaggcgagtttatttgttttatcgggccgagcggctgcggaaaaacgacgacgatgaaaatgattaacagactgattgagccgtcatccggaaagatttttatcgatggcgaaaacattatggagcaggacccggtggagctgagacggaaaatcggctacgtcattcagcagatcggacttttccctcatatgaccattcagcagaacatttctctcgtgccgaaactgctgaaatggccggaacaaaagcggaaggaacgggcgcgggagcttttgaagctcgtcgatatgggcccggaatatttagaccgctatcctcacgagctgagcgggggacagcagcagagaatcggcgtgctgcgcgcccttgcggcggaaccgcctcttattcttatggatgaaccgttcggagcgcttgacccgattacacgggattcccttcaggaagaattcaaaaaactgcaaagaacattgaataaaacgattgtgtttgtaacccacgatatggatgaagcgattaagctggctgaccggatcgtcattttaaaagcgggagagatcgttcaggccggcactcctgatgacattctccggaatccggctaatgagtttgtcgaagaatttatcggcaaagaacggttattgcaatcaagaccggacattgagcgcgtcgagcagatgatgaacaaaaagcctgtcaccgttacggcggacaaaacactttcgcaggcgatccaagtgatgcgggagcaccgtgtcgattccctgcttgtcgttgatgacctgaatgtgctgcaagggtatgtcgatgtcgagatcattgatcagaaccggaaaaaagcgagcctcgtcggcgacgtgctccgctctgatctgtatacggtcgagcagggtacactgctgcgtgataccgtacgcaaaattttaaagcgcggaatgaaatatgtacccgtcgttgatgaacaaaggcatttagtcggaattgtcacgcgggcgagccttgtcgacatcgtttacgattcaatctggggcgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgctgacgagaatgaaaaagggcgcaggcgccgtcatcggcgccgtcaacattgtgcagaccttgccgagtctcgcgatactggcgttttttatcccgctgttaggcgtgggaaaggtgcccgcgatcgtcgcgctgtttttctattcggtgctgccgattctccgaaacacgtataccggcattcaaggcgtaaacaaaaatctgctggaatcgggaaaaggcatcgggatgacggtctgggagcagatcaggcttgtggaactgccgcttgcggttccggtgattatggcgggcatccgcacatccaccatttatctgatcggctgggcgacgcttgcttcctttatcgggggcggcgggctcggagactatatttttatcggcctgaatctctatcagcctgaatatattatcggcggcgccgtgcccgtcaccattttagccattatcattgattatctgctggcggcgacggaacggaaggtgacgccgaaagggctgaaaggactgaaggaagtatcataaggagttggctgttttgaaaagaaaccaaaagagatggatgtgcgcactggcgctgtcagctgctctgcttctgggcggctgttcccttcccggcctgagcggggcttccgatgatacgattaaaatcggggcgcaaagcatgacggaatcagaaattatcgccaatatgctcgcacagatgattgagcacaatacagacttgaatacggcattaattaaaaacctcggatcgaactatgtccagcagcaggcgatgctcggcggtgaaatcgatatcgccgcgacgcgctactcgggaacggatttaacgagcaccctcggcatggaagcggaaaaagacccgaaaaaagcattatctatcgtccagaaggaatttgagaaacgcttccattacaaatggtttgattcttacggatttgagaacacatacgcttttaccgtcacgaaagagcttgcggaaaaagatcatttagacaaagtatccgatattaagaagcatgcggatcaatttaagctcggtgtagacaatgcgtggctgaaaagaaaaggcgacggctataagggcttcaccgacacgtacggttttgaattcggcacaacctatccgatgcagatcggacttgtatacgatgccgtgaaaaacgggaaaatggacgccgtcctcgcttattcaacggacggacggattaaagcgtacgatctgaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttttggagaaacatcattattttgaataagaaatgaggtggggcaaatggaagtgctgcagcagctcggcacttattattctcaaaacggggcctatgtgcttcaggagttttaccgccattttctcatgtcggtatacggcgttttatttgcggcgatcgtaggtgtcccgctcggcatcttcattgccaggtacagaacattaagcggctgggtattcgcggtgacaaacgtgattcagaccgtgccggcgcttgcgatgcttgcggtgctgatgctcgtcatggggctcggcgccaatacggtgattttgtcgctgtttttatattcgcttcttccgatcatccggaatacgtacacaggaatcgccagcattgaacacgcttatcttgaatcgggaaaagcgatgggcatgaccaaatttcaggtgctccgcatggtggaactgccgcttgcgctttccgtcatcatggcggggctgcggacggcccttgtcatcgcgatcggcattacggcaatcggaacgtttgtcggcgcgggcggactcggtgacatcattgtcaggggctcaaacgccacgaacggaacagcgattattttagccggcgccattccgacagcgctgatggccgttatcgcagatcttgtgatggcatggctggagcgggcgctgagtccggtgagaaagaaaaaacgaaccaaagcgccgaatgcggcatgaaaaaaacgccttgcgggtcagggcgttttttttcttatggcttcggaacatgcttgaatatttcttcgctttcaaaaaactcgatcagacggctgatccagttgtagtaatcaagccaatcctttaattctttcagcagttcgttgattttttcctcagcttcttccggcacgccgttttcaaggacggccgtcagttcgcggttcagttttttatgcatcattttatttttgctgacgaccttgctccatgtggccgtaaacagcgtaataaaggtttggtagtaatcctgctcgacgtcgtataaatctttgcggacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaattcggagcaataagaagaactttgccggtcaatacgggtaaatcagtgcttacacaacctttatatataatatggacaaattgtaaactttttaatttacaaagtttaatttataatgggaaacgttcaattgtctgaaaagttaaatttgaatttaacgatttgaacaaatttaatatcggaggtgtgagtgtttgctgacattagaaaatgtctcgaaaacgtataaaggcgggaaaaaagccgtcaacagcatcaacctgaatatcgacaaaggcgaatttatttgttttatcggaccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacattacgctcgttccgaagcttttaaagcattctgccgaaaaacggaaggaacgggcgcgggagcttttaaagctcgttgatatggggcctgaatatttagaccgttaccctcatgaactgagcggaggacagcagcagcgaataggtgtattacgggcacttgccgcagagccgccgcttatcttaatggatgaaccgttcggggcgcttgacccgattacgagagattcccttcaggaagaatttaaaaaactgcaaaaaaccttacataaaaccatcgtatttgttacccatgatatggacgaagccatcaagcttgcagacagaatcgtcattctgaaagcgggagaaatcgtccaggccggaacgcctgatgagattctcagatttccggcgaatgaatttgttgaggagtttatcggcaaggaacggctgattcaatcatccagccctgatattgaacgggtggagcagatcatgaatcccgatcccgtgacggtaacacctgagaaaacactgtcagccgccattcagctgatgcgtgccgagcgggtggattcgctgctcgtcattgatgaaaagaacgttctccaaggttatgtcgatgtggagatgattgaccgcaaacgaagacaagcggtaaccgtcgcggaagtgcttgaacgggatctgtacacggtcagaagcggcactctgcttcgcgacgccgtccataaaattttaaaaagaggcgtgaaatttgtgccggtccttgatgaggacggccggctaacgggaatcgtgacaagggcaagcctcgttgacatcgtctatgactccatctggggagaagagaatcagctcgcggtgatgtcatgaggaggcttcaattgatatgaatcagaccgtacaatttttacaggcaaatggaggagagatgctttataaaacatgggagcatctgtacatctcattaatcgccgtcatggcgggcattctcgccgccgttccgctcggcgtcctgctgacgaggatgaaaagaggagccggcgccgtcatcggcatcgtcaacatcattcaaaccttgccgagccttgccattcttgcgttttttattccgcttttaggcgtaggaaaggtcccggccgttgcggcgctgtttttctattccatgctgccgattctcagaaacacgtatacggggattctcggcgtcaatcggcaccttctggaatcgggaaaaggaatcggcatgacggcatgggagcagatcaggcttgtagagctcccgcttgccgccccggtcatcatggcgggcatcaggacgtcttcgatttatttaatcggctgggcgacgctcgcctcctttatcggcggaggcgggctgggagattacatttttatcggcttgaacctttatcagccggagtatattatcgcaggcgccgttccggtcacgatgctggcggccgccgtcgattacatgctggggtgacagaacggaaagtcacgcctgacgggctgaaaagcataaaggacgctttataaggaggaggtctcacatggggaatagatgcaaaaaacggctgctcgcaatcgcctgtctcggcatgctgctccttggcggatgctcgctcccgggattgagcgccgcatcggaggacaccattaaaatcggcgcgcaaagcatgaccgaatcggaaatcatcgcaagcatgctcggacagatgatcgaacatcacagcgggttgaaaacatccgttattaaaaatctcggctccaacgccgtacagcagcaatccttgatcaacggtgatattgatatcgccgcgacgcgctatacaggagacgcgctgaccgggacgcttcgcatggagccggaaaaagacccggacaaagcgctgcggctcgttcagcgtgaatttcaaaacagatatgacatgaaatggtttgattcttacggctttgataatacatacgtctttaccgtttccggacagcttgccagcaagtaccatttagaaacggtatccgatgtcaaaaaagaagcatcccatctgaaattcggcgtagataactattggatgaagctgagaggcaacggatatcaggattttatgaaaacatacggaatgtcatttgaaggcacgtatccaatgcagatcggcctcgtatacgacgcgctgaaaagcagaaagatggatatcgcgctcgcttattccaccgacggaagaatcatcgcttacggactgaaaacgctgaaggatgataagcggttctttcctccgtatgactgttcacccgtcgttccggatcatgtattaaaagagcatcccgaactggagggcgtgatcaataaaatgatcggcgcgattgatacaaagatgatgcagaaaatgaattacgaagttgacggccgattaaaagagccgtccgtcgtggccaaggaatatttagaaaaacatcattactttgaataacggaaaggagatgtgcggatggacacgatgaaagagttgtttacgtattacgctcaaaacggcagctatgttctgtatgagtgctggcggcactttctcatgtcggcgtacggcgtcgttttcgccgccgttttcgccattccggccggaattgtgacagccaggcacgggcgtctcgccggctgggtgtttgctgtggcgaacgtgattcaaaccgttccggcgcttgcgatgctcgccgtcctgatgcttgtcatggggctcggcgccaatacggtcatcacggctttgtttttgtattcactgctgccgattctcagaaatacgcacacgggcattatcaatatcgagcacgcttatctcgagtcgggaaaagcgatgggcatgacgaaataccaaatccttcgtatggtggagctgccgcttgcgctttccgtcattatggcgggtctccgaacggcgctcgtcattgccatcggcatcacagcgatcggcactttcgtcggcgcaggcggtctcggggatatgatcgtcagaggctcgaacgcgacaaacggaaccgccattattctggcgggcgccattccgaccgcgctgatggcggtggccgcagacctgctgatggcgtggctggaacgagccctcagccctgtgaaaaaacaaaaaagaaagctgatcgtacgctcagcctcatgaaaaaaagcattcttccgcgtgaaggatgctttttttgatttcttgattaaattttgataactgcgctgtaaagtcttacatatcaaataacaaagcagaggggtaatcatatgagcaacatcatagaaacgagacagctgcaaaaatcattcggcagacaacaggcagtggctgatgtgtctctatcggttaagcgcaacagtatatacggcctgctcggtccgaacggcgcgggaaaatcgacgactctcaaaatattgaccggcatgctgcagcaaacatccggcgaggttctgttcgagggacatacatggaagcgcgaagatttgaaaagcatcggttccctgattgaagcaccgccgctttacagcaacctgacagccgctgaaaatctgaaagtccgctgcgtgatgctcggactgcctgattcaagaattgcggaggtgctggaaattacgggattaacgggaaccggaaaaaagcgcgccggacaattttccatgggaatgaaacagcgtctcggcatcgcgttggcattattaaaccgtccgtcgctcttaattcttgacgagccgacaaacggattggacccgatggggattcaggatttgcgggaatttatccgctccctgcccggacagggaatgacggtgattttatcaagccacctgttatcagaagtggagcagatcgcagaccatatcggaatcatcagtgacggcgttttaggatatcagggagaaatcagccgggaagacgatctggagcggctgtttctggaggttgtcaaatcaacacgggagaaagcgggacaggaaaatgattcagtacatgcaggcggaacaccttacatctaaaagaacatttatcagaaagctgatcattctgattccgcttctgaacgcggctttttcttttctgctgaatgcggcctattttatgacgggcacgttcaattggtgggcggttattttcatgccgctcatgattgctctaatgtgcggtttatctgttaaaaaagagaaaaaatcagcgaatgaccgcgcggtgtactcattgccggcagatttaaaaagcatatggttctcaaaaataagtttgatcgcgctgtattcactcctgtcgcaaatcgtctttttagtcatcgtgtttttgcttggccttgtgtttccggcaattgctgcgctgcagctgaaaggcgttgaagcaagctcccttttgtggctgacgacgctttgggaaatcccattgtgcttatggattgccagacagttcggatttacggcagtcattctcatcaatatgatcgccgcctttgttttaggcattgtgccggcgtccggttcattgtggtggctgagtccgtggagctggtcagtccggctgatgtcaccgattctcggaatccacccgaacggaattccgcttcccgcaaacagcggcttattaaacggaaacgtgatcattccggctattattctttctattctttcttttatcgcaataagttttgtttccgcagtgtcattttcaaaaggaggaaaccggtcatgaccgtgcttttacgatatatgtgggccgatgtattaaaaatgaagcgcacgccgctcatatggatgcatgctgcggcgccggttttatgcgcgggatttttcctgttatatatgtatggaagggttcaggagtcttatatgctgtacagcgtctttttcagcgcgattgccgttttataccctctgatcatcagtattgtctgcggcatgtctgcctctgtcgaggaacaggcgggccattttcagatgatgctggcggttccgtattctaaaatcgtcagttttgcgggcaagctgcttctgctgctcctattgaatgtgttatcggttggtctcgccatctgtctttatttggcggggttgaaatttgttcttcacatcaatgatctcccgtatcttctctttttaaaaggaggggcgtggctgattgccggcagtattccgctttatatgatgtctttttttgtcggcataaagtacggcatgggaccgtccgggcttttagggggtgcgggattattaatggcggcgctcatgaatacgggacttggcgatatcatctggcgtttttttccgtgggcatggagcgtgaggctttcaggccttgcaggactgctgcattttgacaaagtcaaaaaagagttcctcccttatgtaagatacgatatgagattcggagaaataatgttatatttttctatagtgatattatgtctggccggcctctattggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctggaaaaagcggaagatcagtcattggatttttttcaaggctatgatttgattcttcttgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtatggatggatgaccggaaactgcctcttacgaaaaacgaatataaaatcgttgaatttctggcacagcataaaaacagaacattctcacgggagcagatttacgaggaagtgtacggcttggacggcgatgcgctctattcaaccattacggagtttatcagaaccatccggaaaaaatgtaaagaacacggggctgatccgatcaaaacggtgtggggtgtcggatacaaatgggaatagcaaaaggaaaatccagcatccgcaaagagcttgtcaaatttaccatcactttgtgtctgagcacgatgggggtggcggcattatgcgtcgccttaaatgccattgccatgaatgccggagcgatcctgcccgcaaactacagcgagcatgaggcggaacagatcaaaccccgcctgaaatcagcggaaaagataacagaagacatgatccccgcaggtatgacatacgccgtttttgataaaaaaacaaagcggatgacaaaaggaacgatgacggaacaagatgcggccaacgccagaaaaaagattcagcatacgccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgactgtttttatcgtgacgacgcgtttcgccaatcagctgagacggcatttcagcacactcagctccattacggcaagcattcaaaaacagaatttaaatatcaatccaaaaaggtcgcgtataaaagaatttgacgatgtcattgactctctgctgaaaatgaaagacgcgcttcaggcatctctggcggcgcagtgggaggcggagcggataaagaaagaacagatcggcgcgcttgcgcatgatattaaaattccggcaacgatcattaaaggaaatgccgagctgctccagttaacagaacctgatgaggagcaggcggaatatgcgcagtatatcctggatgccggaaacaaaatcgagcattatgtcggacagctgatccagctttccaaagcagaggaggcagttgccgttcatgtcgaatataccgacctcaaagagtggattcaaaacatatatcgtgacgcggcggcgcttgcggggccgaagcagatggatctcgtcctcagcgaacggggaattgaccgaatagaagcgccgatcgatcatgagctgctccacagggcggtcatgaatatcgcggcaaatgccgtcgactatacgccggaaggaggggaaatccgtgtggacgtcctgtgcaccgattccgccctccatcttgccgtatccgacagcggaagcgggttctcgccggaggcgctgaaaagagcgacacagcttttttacacggaggataaaagcagacattcggcggggcatcacggcatggggcttacattcgcccatcacgtcgtacatcttcatcacggcgaattaatacttgaaaatcaggagtctggaggagcccgggcggagattcgaattccgctggaaggcgtcagacaaaaacaagccctgcacgcctgagggcttgtttttctgtataagaaaagcaaaaataaaaacggctgtccgtttgagagatcagccgcttatgcggaaaagagtttatcaggaaggatcaatccatgttgaagaccacttggaaatttcctctaaaataggggctaatgcgcagcctttttccgttaaagaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtacgtctggcgcttgttaagttgaggagaggatcaaaaagaggatgaggaatccggggagcgttttttcgcttcagccgcaataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggaggtttcacggatttcctcctgaaatgccttgatgtgtccggcccgcgccattaactcctcgtacgggatttttaatgtgtccgccaattttctgatggtcgcgggtttaggaatgccgcggtgcccgttttcaattctggaaatggtcgccgagctgacgccggaatagacggcaagctgattgacggtaagcttccgggcgcggcgcagctctcttaattgctttccgaatgtgttcaataagatcgcctcacatgtgcaaagtcatgagtcttcatttgttctttttttggcttccgccgataagaacgcaaagtatttatcaagcagaaccaagtcttctttcgacaggtgccgccagttctcccgctccaaaagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcactccgcgtttgccgttttcaatccgcgagattcccgcggcgctgacgcctgaatacgttgccagctgattcactgtcagatgccttttttcccgtaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcgaaggccgggccagctggtcatcggaaaaatgctctattactttgacatgaaatttgaagatcttttttactacgactttgttgacaaaagtcaatgaagatggaagattcaaacgcatttccgtttttctgacatgatgtacaccgatacggcgtgacatgcctttgtttttcatgtaaaatagaagcaatgtaggccagtcagtctggaggtgtatgggatgcacacattattgattaccttattggttatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctagcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagagctggtacatacgggacctgaagattggtggaaagacgtcatggacggttatgagtatttacggtctgaaggctatgaaaacattgcggcgtgcggactgtcgcttggcggggttttttcattgaaattgggttacactgtacccataaagggaattgttcctatgtgtgcgccgatgcacattaaaagtgaagaggttatgtacgaaggagttctctcctacgcgcgcaattataaaaaattcgaaggaaaacagccggagcagattgaaaaggaaatgaaggagtttgaaaaaacgccgatgaatacgctcaaatcgctccaggagctgattgccgatgtgcgcaaaaacgtcgacatgatctattccccgacatttgtggttcaggcacggcatgaccatatgattaatacagaaagtgcgaacatcattttcaacgaggtggaaacggacgacaaacagctgaaatggtatgaagaatcaggccatgtcattacactcgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccattcaggaactcgaggagatgctgaacatcacggaagccgatgaatttaaagagctggtaaaagcgctggtggcgctcgaggagacgggacagatcgtccgcaccagaagcaaccgctacgggcttccggaaaaaatgaatttagtaaaaggaaaaatttccgcgcatgcgaagggcttcgcgtttctgctgccggaggatacctctttaagcgacgtgtttattccgccgaacgagctgaatacggccatgaacggcgatattgtcatggtgcggctcaattcccagtcaagcggatcgagacaggaaggcacggtcatccgcatcctggaaagaagcatcgaccgcgtcgtgggcacatacacagaaacgaaaagcttcggctttgtcatcccggatgataagaaaatcacgagtgatatttttattccgaaacatgccaataacggcgctgcggaaggccataaagtcgtcgtcaaactgacaagctatcctgaaggcagaatgaacgccgaaggggaaatcgttgaaatactcggccataaaaatgatccgggcatcgatattttatccatcatccataagcacggcctgccgggagattttccggctgaagcgatggagcaggcaacaagcacgcccgataccatcgatgaaaaagacatcaaagaccgccgtgatctccgcgatcaggtcattgtcaccattgacggcgccgatgcgaaggatctggatgacgccgtcaccgtgacaaagcttgataacggcagctacaagctcggcgttcatattgccgacgtcagccattacgttacggagaattccccgattgacaaagaagcgctggaaagagggacaagcgtgtacttggttgaccgggtcattccgatgatcccgcacagactgtctaacggaatctgttctttaaatccgaaggtcgaccggctgacgctttcctgcgaaatgacaatcaaccagcagggacaggtgacggagcacgagatcttccaaagcgtcatcaaaacgacggaaagaatgacctattcagatgtcaaccggatccttacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaggtgctcgtcgatgaggaaggcgccgtaaaagacgtcgtcatcagagagcgctcagtagcggaaaagctgatcgaagaattcatgcttgtcgcaaacgaaacggtggccgagcacttccattggatgaacgtgccgtttatttaccggattcacgaagagccgaacgccgaaaaactgcaaaagttcttggagttcgtcacgacattcggttatatcgtcaaggggaaagccggagacattcatccgcgcgcgctgcaaagcattcttgatgaagtgcgggaccgtccggaagaaacggtgatttcaacggtcatgctccgttccatgaagcaggcgaaatacgacccgcaaagcctgggccatttcgggctggcgactgaattttatacgcacttcacatcgccgatccgccgatatcctgacttaatcgttcacaggctgatcagaacgtatttgatcaacggacaatcggacgaagcaactcaggaaaagtgggccgaacgccttccggaaatcgctgaccatacgtcaacgatggaacggcgcgccgttgatgccgagcgggaaacggacgatctgaaaaaagcggaatatatgcttgataaaatcggcgaggaatttgacggcatgatcagttccgtcacgaatttcggaatgttcgtcgagctgccgaatacgattgaagggcttgtgcacgtcagctttatgacggatgattattaccgttttgacgagcagcatttcgccatgatcggtgaacgcacgggcaacgtttaccgcatcggagacgaaatcacggtcaaagtcgtcgacgtcaataaagatgagagaaacatcgactttgaaattgtcggcatgaaaggcacccgccgtccgagagaaacaacaggcgaccgcagaaaacgaggcagaccggcgcggaaacgcgtgttaaacagcaataccccggcttcaccgccgaaatcggaggaaaaaggggaatggtttacaaaaccgaagaagaaaaagaaaaaacgcggcttccaaaacgcgccgaaacaaaaacgcaaaaagaagaagtaaatgcgaaaagcaaatagggcataatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacggagattaagtccatccgcgccggccgcgtaaacatgaaggattcctttgcgaaaatcgagcgcggcgaagtgttcctccacaacatgcacatcagcccgtacgagcagggaaaccgctataaccacgacccgctccggacgagaaagcttttgatgcaccggaaagaaatcaataagctgatcggcctgacgaaagagaaaggctattccctcgtgccgctgaagctgtacttgaaaaacggcttcgccaaagtattaatcggcctcggaaaagggaagaaaacatacgataaacgtgaagatttaaaacgaaaagacgccaaaagagaaatcgaaagagcgttcagagacagacaaaaaggcttctgatgcctgagccttgatgtgatgatatgccctgtgctatactgttcacacatcagattcacaggctgtttattgaagatattcccaattgaatttgcctgtgatcatggtataataacagtacagccagttgagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcatgaagacgagtgaaacacgaaatatgcaggctacgctcgtagacgcttaagtaatcgatgtttctggacgtgggttcgactcccaccgtctccatacataacagaggaaccgcagtgccgtcacatgacgcactgcggtttttttatgccgacaaaaaggagtgaatgtaaatggaaatcgtcatcatagacggaaaagatgttacaagcacagaagctttacaccgaatcttaaaagatcaattagatttcccggacttttatggtgaaaatctgaacgccttatgggattgtctgacaggctggatcgaacttccgctgactttggtgtggaagaattttgagatcagtcagaaggaattgggttcggatgctgatgatgtcttggagctgtttcaagaggctcaggcagaattagatggtgaatttttcattcaaattgatcagccgtcagccgggacaacggacaggcactaaaaagtgcgtacttcccctcatccatttttctatccgataatagggacggaaggtttcaggctttcgatttctgtccatatataagaagagacttgcgatagggaggaatggatgatggacttgcagttgaaagggaagacggcgcttgtgacgggatctacgtcaggcatcgggaaggcgattgcggcttcgctgattgcagaaggtgcggccgtgatcattaacggccgccgtgaagaaaaggtgaacgaaacgatccgggaactagagaaacagacgccggatgcccgtctctatccggccgcgtttgatttaggcacggcggaaggatgcggcgcgatttttcagcagtatcctgatgtggatattctcgtcaacaatttaggaatctttgaacctgcggaatactttgatattcctgacgaagagtggctccggtttttcgaggtgaatatcatgagcggcgtgcggctgacacgccggtatgcaaagcggatgattgagcggaaggaaggacgggtgatctttatcgcgagtgaagcggccgtcatgccttctcaggaaatggctcattacagcgctacgaaaacaacgcagctgtcgctgtcacgcagcctggccgagctcacggaagggacgaatgtgacggtgaatacggtcatgcccggctccacgaaaacagagggcgtcgaaacaatgcttgagtcgctttatcccggtgaaaacttgacagcggctgaagcggagagacgatttatgaaggaaaatcgtccgacgtccatcattcagcggttgatccgtccggaagagatcgcccactttgtcgcctttttaagcagcccgctgtcgtctgccattaacggatctgcattgcggatcgacggcggcttggtgcggagcattatataagatgaacataaaaaacccccgcaaagtggcgggggtttttttaatgcggatcacgctgaaaccggctgatgatcctgctgattaaatcttttgttgcacagtcaaagtgctcttctttttggtttgtcaaaagcccgacaggcggtgaaattgttaagttatggatcggaatgaccttcgtgccctcgatcggctctgaatgcgccgtcgccgtaaagattgagacgccgatattttccctgacatagtattgatgagccatgctgctggtcagctccatttttcgatagcggctcccgatggcccgctgcaggtgctgttcaatttgaatccggatcgggcaattggcgggcgtaaaaatcaggcattcattttctaaatcttcgagattaacgcttgctttggcggcaaggggatgtctgtctgacacgatgacattgagcgagtcatggaaaaacggatcgaaataattttccagaatcagctccggctcgccgcataccgcaaaatcaatagcgccctccagcagtttgcggctgcatgtattggcatcatccacgctgacattgaccgacatgtccggataatcatttaagaaaccccgcagcacggcagggaagatcaggcttgccgtcggttcggatatgccgatctgaataaggccggcctggccctgtctgatatcggccagagtatggtcaagcacctcgtattgcgcgagaagctgcccggcccgctcatgaaacagccgccccgcccttgtcagcttcagcttctttccacgttcaaacagctgcgcgcctacatcctgttccagctgtttaatccgcattgaaatcgtcggctgtgagtagttcagaatttctgcagccttataaaagctgcctgactgtacgatggtatgaaacgttttaatggttcgtagttccaacgaaatcccctcccggctgttcattaattttcttgaacctttcctttactttttttgattagtcaaacaaatcagtttgctttatagtataaacaatcaaagcttagtaaacaaattggaattatatattttttgcggggagagtgaccggaatgagtgaagacatatttcgattggctgagaaaaaggatgcgccggagtttttagagctgctgtacagcgcgtttcagccgatccgcaatttggagattgactggccgtcggcgcgggccgacatcgatatggtaacggaaaatattgaaaatcattcagccgtcgtgctcgaacgggatggacggcttctttcaaccattacgatccgttttccgtgggagagtgacacgcctccgtcaaaatatccgtttgtctggtggtttgcgacgcttcctgagctgaaggggcagggcatcggcagcaaacttttgacttatgtggaggaacatgtgctgcgggatacgctgaaggccccggccatcacgctcggcacttcggcgcgcaagcatccctggcttgtagatatgtacagacggaggggatatgaagtgtattttgagcaggagaaagacggagacatcggagttatgatgagaaaggtgctcataccggagcggtttgacgcgtcgctgttaggcacaccgagctgggcgcaatgatcaaaaaacggatcagagccggctgtctgcttctgctgctcggcgtgctggccgggtgcgggcaaggagaaagcgcaaaagcggggagcggcgtgcagaccgtcatcgtcggcacgggaactgattttccgaacattgcttttatggatgaaaaaggcgagctgaccggctatgacattgaagtgatgaaagccattgatgaacagctgccgcaatacaaatttgtctttaagacgatggatttttcgaatctgcttacaagtctcggaaaccggaaaattgacgtgatcgcgcacaatatggcgaaaaacaaggaacgggagaaacgctttttgtatcacaaaatcccgtataactactcgccgatgtacatcacggtgaaggcggataatgacgcggtacgcacgctccgggatttaaaagggaaaaccgtcatcgtcggcgcgacgtcaaacgcggcggattatatgacggcatacaacaaaacccacggcagcccgatacatttgaaatacgccgggcagggcggcaatgatacagcgaaccaaattgagacaggacgcgctgacgccaccgtatccacgccgtttgccgtcgattttcaaaataagacgcacgcgttcaaacaaaagacggtcggtgatgtgctgctcgataccgaggtgtattttatgttcaataaaaacagccaaaccctggcggacgatacggatcgggcgattcaaaggcttgtgagggacggcacattgaaaaggctgagtgaaaaatggctcggcgcggattattcaaaatcaagtttcacgaaataattgaagcagaaaacggggcgatcacatgaaaataagattggcggtcatgtcattaacaattgcggcaacggcggcgttatcagcctgcggcgcgggaggggaggcggcatcaggcaatcagaaaaacgtgaagaacattacggtcggcacggggactcaattttcgaatatttgctttattgatgataaaggcaaattgacgggctacgacgttgagctggtgaaagagcttgacaggcgcctgccggactatcgatttacctttaaaacgatggatttctccaacctgcttgtcagcctcggccagcataaagtcgatatcgtggctcatcaaatggagaaaagcgccgaacgggagaaaaaatttctgttcaatcaagtcgcgtataacaacttcccgctgaaaatcacggtgctccaagataatggggacattcacggcattaataacttgaaaggaaagcgggtcattacaagtccgacgtcaaacggcgcgcttgtcctgaaaaaatggaatgaaaaacacggcagtccttttgaaatcgcctatgccggccaaggttcaaacgatgcggccaatcagctgaaatccggccgcgccgatgcaacgatttcaacgccgtttgctgtcgattttcaaaacaaaacgagcgcgatcaaagaaaaaacggtcggcggggtgctgtcaaatgccaaagtgttctttatgtttaacaaaaatgaacaaacgctgagcgatgacattgataaagcgctcaaggaaatcattgatgacggcacgcttaaaaagctgagtgaaaagtggctcggcgcggattattcaagggagcaatattaagtgaaaaagagagggaccggcaatggaaaaagcgtttgatatcagtatgatcgcgtcctttgtgccgacattgctcgggtatttgcccgtcacgctgtatatattggcggtgtctttgctgttcggctttctattggggctgcttttggcgctgccccgcatctatcgcattcccgttttgaatcagtttgcgaagctgtatatctcttttttcagaggaacgcctatcatggtgcagctgttcattgtattttacggcattccggcgctcacggcgctcgccggaattgatacctctaaaatggaccctttgtatgcggccatcgccacgtatgcgctgagcagcgcggcaagagcggccgaaatcatcaggggaggtgtgaacagcgtcggccgcgggcaggcggaggcggcgttcagcatcgggctgaacagagggcagacattccggcgcatcattctgccgcaggcgctcgtgcaggcctttcccaacatcgggaatatggtgatcggtttcttaaaagatacatcactcgctttttcgatcggggtgatggatatgtcgggcagaggacagaccttgattacatcgagcaatcattctcttgaagtgtatatctcgctgtctgttctgtattacgcggccgcccttttatttgaatgtgtcttcagatgggccgaaaaacgaatcaagaaagatgagacgcgccttgtgacggtttttgacatgagtgcgcacggctgaaaaggagggagaacagtggagctggacattccgtttatcggcactgcgataaaacaaatgttgaaaaccgttccgcttacattggcgatgacgatcattccgattattgccggatttttcatagctctcggcaatatcacggtgcgtatattccgcatcaaatggctgctggcctgctcagcgttttacgtgtcttttttccgcagcaccccggcgattctccatattatgctgatttatttaggggttccgctgattgccgatcaattcagccgcgcgtttcatctcggctggtcagccaatcagattccggtcgccgtgtttgtcatcatggcactgtcattaacggcaggcgcttatatgacggaaattctccgatccgggatcatggccgtcgatacggggcaggcggaggcggcatattcaatcggtctgacgcggggccagttgattcggcgcgtaattctgccgcaggcgttcatgatatcgctgccgaacttcaccaatataggcatcggctttttgcataccacttccatcgcggcaattgttgcagtgcctgaaattacaggaacggcgacgattgcggcatccgataactatgcgtttctggaagcatttatcggggcggccgtgatttattggggattaacgctgattctcgaagctgtaaacagtctggcggaaaaaagagcggccagatatcaaggaggcgcattatgatcgaaatccgaaacattcagaaatattttggcagtcatcacgtgctaaaggggatcaatttaagtgtccggaaaggagaagtcgtgaccatcatcggcccgagcggttccgggaaaaccacttttctgcgctgccttaatttgcttgagcggccggatgagggcgccatttcgctgcacggtgaagtcattaactgcaaaaagcctgccaaaaaagacattctcagactgaggaaacagacagcgatggtttttcagcaatatcatttgttttcgcataaaacggcgattcaaaatgtcatggaaggcctgacggtcgcaaggaaaatgaaaaaaacagacgcgtacgccattgccgagcgggaactggccaaggtggggcttcaggataaactacacgcctatccgaatcaactgtcgggaggacaaaagcaacgggtcgggattgcccgggcgcttgccattcatcctgatgtgatgctgtttgatgaaccgaccgccgccctcgatccggagcttgtcggcgaggtgcttgaggtgatgcttaacattgtgcggaccggcgctaccatgatcattgtcacacatgagatggaattcgccagaagagtgtccgaccgaattgtgtttatggatgaaggagcaatcgtggaacaaggaacgcctgaggaagtttttcacaagacgaaaaaagaaagaacgaagaagttcctccgccgcgtgctgcctgattacggttatgacataaaagagcgcataaaggagcctgtcgtatgattcgtttaagcattttagatcaaagtgtcaccgcggaaaaccaaaccgcagaagaagccttgcggcaaacggtgaaattggctcaggaggccgaacaatacggatatgaccgtttctgggcggcggagcatcataacaatgaagagatagcgggatcagcgccggaaattgttctggggtatcttgccgcaagcacgaaaaaaatccgtctcgcatcaggcggggtgatgctgcagcattacagtccttataaagtggcggagcagttccgggttctgtccgcccttgctcccggccgtgtggcgctcggtgtcggcaaagcgcccggcggatttcagctgtcaaccgatgcgctgcagcgggagcttatccagcccgcccgtttgtttgaagaaaagcttgaggagctgactcatttcattcgaaatgattttccggactcgcaccgctacgcgtcattgcggccgacgccgcatactgagtatgcgcctgacatctttttgctcggcagcagcgcggaaagcgcgatatccgcggccaaactcggcatttccttcgttttcgcctatttcataaacggtgaagaggctgcgttagaaaaagcgcgccacgcctttgacgagcatctgccgaaaggatcgaaggcggaatttcaccttgcgccgatggtatttaccgcgcatacaaaagcagaagcggaaaaacacgtcgtatcgcgtgagtcggtcaaaatcattctcgaagacggcaaaaaggtgaatgtcggttcccgggaacaagcggaagcgtttctggaacaagtcacgcagccatataagctgatcacacaaaagacgggtgtgattgccgggacaaaagaagagaccgccgccgagctgagacgattatccgttcaatacagcattaccgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacagggctgctcctattgcgatgaagtgaaaggatatttgcgggaaaaagccgttgcatacgaaacaattgatgtgacagaacgggacgaattgcgtgacgtgctgcagacgaagtacggcatccgtcatgtccccgtcgttgaaatcggcagcggtgacagccgtgtgtatcaggccgttactcaagtcggcattgatcatgtagaacgggcgcttgccgattacgaggggaaaaagggggagagaaaatgagccggacggatctaattcaattcggagccatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcatttcttaaatcggtttgagccgatcactattttatcggcgcttgccgcctctacaacccatcttggtttaatcggcacattttccacctcgttcactgagccgtttaccatcgcaagacagctgatgtctcttgaccatatcagcggcggccgggcgggctggaatctcgtcacctctccgcaggcgggagccgcgcgcaatcacagcaaagaaagtcttcccgaccacagccggcgctacgacatcgctcaagaacatgtggacgtggtgcgcggtctgtggaattcctgggaagaagatgccttcgtccgcaacaaagaaaccgggcagttttttgatcctgacaaactgcatcgcctatatcataaaggcgagtattttcaagtggagggcccgctgaatatcggccggtccaaacagggagagccggtcgttttccaagcggggtcttcagaaaccggccggtcgtttgccgcgcgtaatgccgatgcagtctttacgcactccaattcacttgaggaaacgaaagctttttatgatgatgtgaagaagcgggcggcggattacggccgcgacgcttccaagctgcggatctttccgggaatcagtccgattatagccggttcacaagaagaagcggaagcgaaatatcaggaattcgccgagctgataccgatagagaacgccattaaatatgtggccagattttttgacgattatgatttgagccgttttccgctggatgagccgtttcctgatttgggcgacgtcgggaaaaacgcgtttcaaagcacgacagaccgtatcaaaagagaggctaaagccaggaatcttacgctgcgtcaagtggcgcgcgaagccgcgtttccgcgaacgaactttatcgggacaccggaacgtgtggcatcattaattgaaacatggtttcagcgggaagcggcggacgggtttatcattcactctgacatcccgggcatgcttgaagcctttgtggatcaagtcataccgatccttcagaaaaaggggctgtaccgaaaaagctatccggcggatacattgcgggggaatctcgggttggatattccgatctgcaaaccaaatccgattttgagcagaaactaaatgtttctgctttttctgctgcttgccattcccgtcattacagccttttttaaaaaatatactgatttcgagatattattgttgcgaaaagaattttttgtaactataattattacagaactgatcagtataaaaaaacattcatatttcataataaatgtgtgtgtaatttgaaaacgaaagggctgtttacaatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgacgcggatgtattcagcggctggggaaaacttcaatccggcacaggatttgaagagctttctgaaaacgaaaaagcgaaagtcggccgtctgaacgagctgagcgatcaattcgcgtcagctgacaaatacgtattcgtcacaccgctttggaacttctcattcccgcctgttatgaaagcgtaccttgattctgtggctgtagccggaaaatcattcaaatatacagagcaaggcccgatcggcctgttgactgacaaaaaagcgctccacattcaggcgcgcggaggctattactctgaaggcccggcggctgacatggaaatgggccaccgttacatcggcatcatgatgaacttcttcggcgttccttcttttgacggtttaatcgttgaaggccataatgctgaaccgaataaagcacagcaaattaaagaagatgcgattgcccgcgcgaaagaagccggaaaatcattctgatcttaaaaaaaacctccccgccgtacggctgggaggttttttatattaaagggcaatcgtccgtttttgctcgctgcttttcatcgccgcttcaatgacacggatgacatcgatgccttcttttgccgtaacgggaagctgttttccgtttaagatgctgtccgccagcagtttgtagtacgtaaggtaagagccgttctcagaggggattgtttctgtatgccttttttcatccgctgcgattgtcagctctccgaagttgtcagggtcatcggcgccccagctgtcgtcaatcggcttttggccggctgaaagcgcctcttcctgtccgtcctttccgtatttgataaagcttgcattccgtccgtgaatctgatagcgcgggccgtttgccgcattcatagagccggattgaagaatgacctgaagtttgccgtaatggagcgcggccagaaaataatcgacggtttcactgttgtcccgctgtttcatcacatgtgccgtgacggattccggcattccgaaaagcaggagtgtctggtcaataatatgtgaaccgagatcatacagcgttcccgtggcgggtccgcttttttcgcgccatctttcttggacaaccggattgtacagatcgtagttgacttgatatgtatgaatgtcttgaagcgccccgtcccgaatcagcttttgtatcgttaaaaagtcattgtcccagcgccggttgtggtacacgctcagtaagacgcctttatcttcagccgttcttctcagttcctccgcttctgctgaagtcgccgtcatcggtttttccacgacggtgtgttttcccgccaggagacatttcatcgctgattcataatgcattccgctcggtgtcgtaacgatgacgagatcaatgtcaggatcaccggtaatgtcttcaatcgcgcgcacggcttcagcccccggcagatcacgtctgacctcatccgttctggaggtcatgacttttttgatctgataatcatcaaggacgtccaaaagcggcgcatgaaagactttacccgacaaaccatatcccaatatgccaacctgtatcgttttcaatgaatttccccctcttgatatgtgataacattatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaggaaaaagaccagattctgaaccggctgaaacggattgaaggccaagtcaggggcattcagaatatggtggagaacgaacgatactgcgtggatattctcgtgcagatttcagccgtgcaggcggccatgcagaaagtcgcgtttcatctgctggaagatcacgcccatcactgcgtagccggcgccattgagagcggaaacggggagcaggcgattgccgagctgcttgatgttgtgaaaaaaatcgcaaaatcgtaaaataaaatgttttgaaataccctacaggggtatggtaacataaaaaagaaaaaacaagacgtggagggaatcatcatggaacaaaaaacactgcaagtggaaggcatgtcctgtcagcactgcgtaaaagcagtagagaccggagtgggagaactgaacggagtgacggcggttcaggtgaaattggaagccggacaggtggatgtgacgtttgatgagcacaaagtctccgtatcagatataaaagacgcaattgaagatcaagggtatgacgtcgtataaggtttatcgcgctgcgggaacgggcgcggttttcttttatcataattataccctcgtggggtttatgaagagagatgaggacattgagtgaaccgaaagaaatgaccattcaagtggggggcatgacatgcgccgcctgcgcttcaagaattgaaaaagggctgaaacggatggacggcgtcaatgacgcttccgtcaatcttgcgcttgagatctcaaatatttcctatcagcctgacaaaatcgaagctggcgccataaaggataaaattgaaaaactcggctatcacgtcgtgacggaaaaagccgattttcagattgaaggcatgacgtgcgccgcttgcgccaaccggattgaaaagcgcctgaacaaaacagagggcgttgtgagcgcaccggtgaatttcgccctggaaacagtcaccgttgaatacaatccgaaagaggtgacgccgaaagagctgaaagagaccgtggcaaaactcggctaccgattagacgggaagaaagcggttgatggagacggcggattatcccaaaaggagaaagagcagcgaaagcagctgatcaggctcatattttctgccgttctctcctttccgcttttatggtcgatggtcagccatttttcttttacttcttttatctggatgccggatatcctgatgaatccgtggctgcaatttgcgcttgccaccccggtgcagctcgtcatcggctggcctttttatacgggagcgtacaaggcgctgagaaacaaaagcgccaatatggatgttctcgttgcgctcggaacgacggccgcttacgcatacagcctgtacatgacgattgcgtctctcgggcgagacggacatgctgaggggctttattatgaaacgagcgccattttgctgactttgatattgcttggaaagcttttagagatgaaagcaaaaggccgctcatcagaagcgattaaaaagctaatgaagcttcaggcgaagacggcggcggttgagcgggacggcaaagtacaggtgattccgattgacgaggtccggacgggggatatcgtatacgtgaaacctggagaacgcgttcctgtcgatggcgaagtgattgaaggccattccgcgattgatgaatcgatgattacgggagagagcatgcctgtcgataagtctcccggaagcaccgtcacaggggcgacgatcaatgcaaacggctttctcaaaatcagagcggtgaatgtcgggaaagataccgcgcttgcacacattattaaaattgtggaagaagcccaaggatcaaaagcccccattcagcggctcgcggatcacatttccggcattttcgtcccgattgtgctggggctggccgtgctgacttttctcatttggtatgtatgggcggcgccgggacagttttctgaagcgatcggcaaattcatcgccgtgcttgtcattgcctgtccgtgcgcactggggctcgccactccgacgagcattatggcgggctccggccgtgcagctgaattcggcattctctttaaaggcggtgagcatttagaaaagacccagcgtctgacgacaatcgtactggataaaacaggaacggtgacaaacggcagaccggttctgacagatgccgtaccggcagagggaatgaacgaagaggaactcctgcggctggcggcggccgccgaaacgggatcagagcacccgctcggagaagccatcgtgtcaggagccgaaaaacgggggatttccatcccgaaactcacccggtttcaagcccggatcggttccggaatctatgcagaggctgacggcagaacgattctagccggatcaagacggctgatggaatcagagcatattgaacatgaagcgctgcttccgcaaatggcccgcttggaggcggaaggaaaaacggtgatgcttattgcggcagacggcaaagcggcggggcttatcgcagtcgctgataccattaaagaaacatctccggccgcggtgaaacgtctgaatgatatggggcttgacgtcatcatgatgaccggtgacaacaaaaagaccgcggaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcaccgatatcgcaatggaagcggcggacattacgctgatccgcggagacctgaacggcattgccgacgccatcggcatgagccggctgactatgagaaacatcaagcagaatttaggatgggcattgggctacaacagcatcggcattccgattgcggcagccggctttctggctccgtgggtggcaggcgccgccatggcgttcagctcggtatcggtcgtgcttaatgctttgcgtttacagaaggtgaaaaaagacaaaatcggctgatgccggttttgtcttttttattgacactttattcaaagcctgcatataatagagaaaacacttatatgagtatatgctcatatatataaattcgtttacctgtattgatgttatgggaatcctattacggaaagtagggtgagtcgaaaatgaaagcagccaaaggtgaatttgtattagacggacttgattgcagcaactgtgcaaaaaaaatagaaaacggcgtaaaagccattgacggcatagacggctgtgctgtcaattttgcggcaagcaccatcacggtctcagccggcgggaaaaacgagcaatggatgaaagatgaagtcgcgaaaaaagtaaagtccattgatcctcatgtgaccgttcgttcgaagcacgaagacaaacccggtgaggatgaataccgcaaaaagctgcagctgatgttagtgagattggcggcgggcgccgttttggccgtcatcgcttacttcgcgcacacgggcgccgtccttgagtttctgctcttttttgcttcatatttgatcatcggcggcgatatcgtagccagagcgggaaaaaatattgtccgcggccaggtatttgatgagcattttctgatggcgcttgccacaatcggcgcatttatcattcatcaatatccggaaggcgtcgcggtcatgctgttctaccagatcggtgaattgtttcagggagcggccgtcagccgatccagaaaatcgatcagcgcgttattggacatccgtcctgagtacgccaatgtgaaaacggaaaacggcatggctgccgttcccccgcaggacgtcaaagtgggacaggtcatcatcgtgaatcccggagaacggattccgctggacggaaaggtgctgagcggttcctcgatggttgatacatccgctttaacgggcgaatccgtgccgagaaaagcggagccggggcaagaggtgatggccggatttatgaatcagaacggcgtgcttcatattgaaacctctaaagggtatgaagactctgccgtgtcaaaaatattgaatctggtcgaaaatgcggccggacgcaaagcgaaaacggaaaactttattacgaagtttgccaagtactatacaccggccgttgtcattgttgcggtgcttctcgcctttttaccgccgcttctcgtgccttcagccgcgctatccgactgggtgtaccgcgcgctgattttccttgtgatttcttgtccgtgcgcactcgtcgtctccattccgctcgggtttttcggcggtatcggggctgcgtctaaagcaggggtgctcgtgaaaggcagcaactatttagaagcgctcaatcaggtggcatacgccgtgtttgataaaacgggaaccttaacgaaaggcaatttcgccgttactgatatcaaaccggcggcaggatttacgaatgacagcctgcttcatgcagccgcgcttgcagaagtccattccaatcatccgattgcttcttccatccgcgaagcttacaatcaaccgctcgcggctgaggagattgaagaatatgaagaaatacccggacacggcattcgggtgaaaaccggcggatcaacgattttggccggaaatcaaaaactgctggcaaaagaacaaatcgcttccggcacagctgaaaataacggaaccgtcgtttatgtcgccgtggatcagcagtatgcgggggcaatcgtgatcgccgatgaaatcaaagaggacgccaaacaggccattgccaatttaaaagcgctcggcgtgaagcggacagtgatgctgacgggtgattcaaagcagaccggagaagctgtcggcctcgagctcggtattgatgacgtgtacacagagcttttgccgggtgacaaggtagaccgcgtcgaagaacttgaagcggcgctttcaccgaatgaaaaactgatgtttgtcggcgatgggattaatgatacgcctgtgcttgccagagctgacatcggagctgccatgggggctctcggttctgatgccgccgtcgaagcggccgatgtcgtcctgatgacagaccagccgtcaaaagcagccgaagccatccggattgcacgccgcacacgccggatcgtctggcagaacatcggatttgctttaggcgtaaaaatcatttttctcttgcttggcgcattcggattcgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcgcctgttacggtagttgaattcggagattacaaatgtccgtcatgcaaagtatttaacagcgatatctttccgaaaatcaaaaaagattttatcgataaaggcgacgtgaaattttcatttgtgaacgtcatgtaccacggaagcggctcgcgtctggcggctcttgcttcagaagaggtgtggaaggaagacccggcatcattctggactttccatgagaagctgtttgaagagcagccgtcaagcgaacaggaatgggtcacgcctgcattgcttgaaaaaacggtcaaaagcaccgcgaaaaaggttgatcctgacaagctgaaggaaaaccttgataaagaaaccttcgcaaaagagctgaaagctgacactgacctgaatgataaattaaacattacggcgacaccgacgatttatgtaaatgacaaggtgattaatgacttctctaaatatgatgagatttcaaaaacgattaagaaagagctgaaaaatgaaaaatagaatcgtgtttttatatgcttcttgggtgatagctcttgctgccatgctcgtcagcctttatttcagcgagatcagaaaattcataccgtgcgagctgtgctggtatcaaagaattctcatgtacccgcttgtcctgattttaggaatcgccaccttccagggtgacacgcgcgtgaaaaaatatgtgctgccgatggccgtcatcggcgcatttatatcgaccatgcattaccttgagcagaaggtgcccggtttcagcggcatcaagccgtgtgtctacggcgtgccttgctcatctgaatatattaactggttcggtttcattaccattcctttcttggcattgacggcatttattctcattattatctgcatgtgttttgtcaaaacggaacgcacggcaaaataaagagcctgctccatgggagcggctctttttctattatttgtaccaagctttgtttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaactcgattttgcggtaaaaccgacgacaaaatgataattttgatttctgaagctgctttggagattcgataaaatctgagaactgtttgagccggaagaattccaagcctgcacggcctgtacgacgaaatcaatgttgtgatcacggttaaaagcgacatccgcctgctccacgatctggacgattcgcgtttgccagtcgctgtatttggcgcggtattcagcgtccgccaccgccagcactctgaccttctgggagcccgtgctggctttagttgaggctttatcctgactgacattggcattgaatcgtttcgtgccggcctgcttgccgttctcatccagaatttttgtgtcaaccgtctgttcaacttggaccgggcctttcagatctttaaaatgatcggctttcggaagcgggtccgtatacaccgttttcgccggctccgcatgagtgtgcgaatgcgtatggctttcggctgacggcaggccgggaattaatccggcggccaataaaacaggaaaaacaagtgaactgattttcatctcataaccccctttttgttagagaaagtattcaatgaaacttccaataaaccttccattaaagtataaaataggaaaatattcttgctttcagccgttgcggatgaggttgtcccggatcaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatatcttggggattgtaacggcgttcggcggcggagccatccgaaacctgctgatcggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggcgctttatatgccgtgaaaatgggccatccgctcagtgcggtgattgcggcagcggtcctgaccggcagcgggggcggcatcatacgggatttgctcgcgggcagaaagccgcttgtgctcaaggcggaaatttatgcagtctgggccgcgctcggagggttaatcgtgggcctcggctgggccggggatgccgccggtttgtatgtgctgtttcttgtgcttgtggcatgccgcatctgcagttatgtgttcaggtggcgcctgccgattcgttcctatcatatagaacagtaaaaaaaccgatttcacaaacgaaatcggtttttttgcataacggcttctgataaaaaaagacgcccgatatgataagaaaaagggtatttgaccataatgctgaataatatgttgcatatatgtttgtatgatgaaagccggacttgtcagcttgatgtcggaggtgccgctgatggcaaaacgtgataaagagtggaaagaagagcaggaaagaatcaattttgtcatgaaggaactggaacagaaacaaactcatcttgaagcctcatcgggcggattgaagcaggatattgtcggcctgagaaaaacgttttgggatgatgtcaccgtgaatatggatgatgcccacgaagcggctgagacatttttaagcattaaacagcaggcggaaatgctttcagaacgtgaacggacgcatcggcttcaataccggcagcttcaaaaaatccaaaagctgaaaacctctccttacttcggccgtgtcgattttacggaaaaaggggagtcctcttccgagcggatttatatcgggctgacttctttaatggatgaaaacaacgagcaatttctcatttatgattggcgcgcgcccatctcatctctttactatcaatattccccgggaaaagcccgctatgaagttccggaagaaacgatagagggagacatcacactgaagcggcagtttatcattaaaaacgggacgcttaaagcgatgtttaacacggatatgacgattggtgacgaaatgctgcaagaggtgctgagcggccattccggacagcatatgaaaaacatcgtgtcaaccatccaaaaagaacagaacgaaatcatccgggatgaaaaaagcaaatatctcatcgttcagggagccgccggaagcgggaaaacatccgcggcgcttcagcgggccgcttacttgctgtaccgcgggcgcggggtgcttgatgcccgtcagattgtattgttttccccgaacattttgttcaacagttatgtgtccgccgtattgccggaattgggagaagagaatatggagcaggccacctttcaggaatatatcatccgccggctcggacgaaagtttgattgtgaaagcccgtacgagcagcttgaatattgcctgactgaacaaaataaggacgcactttccgtaaggctcgcagccattgcttacaaagcgtcatcagcttttcaggccatgattgaccgctatgccgggtcgctttcggtctcgggcctgaaatgtaaacagatcagcttccggggagacatcctgatttcaaaagagcggattgaagcctatttttattcgcttgatcagcagctgccgattccgaacagagcggagctgacggcggaatggcttctcgcggaaatcagcgctctcgaaaaaaaggagcgtaagaaggaatgggtcttgcaggagagcgagctgcttgataaggaagactatgctgaggtttatcaaacactcaagaagcaggcggcagatgatgaacctgcatttgacgaccatcagcgcgaacagcgcctgcttggcgccattattgtcggcaaagcctttaaaccgattaagcaggccgtcagacggctcggctttctcgatataaaacggatgtatctccggctgttttcagactggggagctgatgaaaagcccgatcattgggagagcatcggcgctttgaccggaaacgcatttgcagaacggtcgcttccgtatgaagatgccgctccgtatctgtatttgcaggatctgttagaaggaaaaagaaaaaacacacaaatgaagcacgtcttcattgatgaagcgcaggattattccccatttcagctcacgtatattcaaaccatcttcccggcggcaaagatgacggtgctcggtgatgtcagccagtcgatttatgcccataccattacgggcccttcttccctcgccggctgctttcgcaatggtgcagaaaagtatgtcagcctgaagcggacttacagatcgacgcggcagattgttgaatttacgaaagcgctgctggctgacggcgatgacattgagccttttaaccggaacggggaaaaaccgcgtgttttgcggacggatacagaaaatgcgcggcgggaacaattggcggatacaatccgggagctcagacaaaaaggctgggagacggtcgccgtcatctgcaaaacggccgcggaagccaaaaaagtgtttcaggcggtcagcgccgagagcggtgtccgtttaatcaataaagaaaaccagccttttcaaaaaggggtatgcgtcattcccgtttatttggcaaaaggcattgagtttgacgccgtcatcgccgctgacgcctctgctgcccagtacaatagcgaacatgaccgtaagctgttatatacggcctgtacgcgggcgatgcatcatttgaccgtattgtctccgggagaaccctctccttttataaaagaagtgcccgccggcttattcgtataagccctttgctgagtgcaaagggctttttatcattagtaatcttaatcgttgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggctatttggctgcggcccggtccgaatccggtgaaacagccgcgcccgctgctcaggctcctgctgaaagcccggcagtctcgaaagaagtgaccgtattatacggatcgcaaacgggaaatgcggaaggtcttgcgaaacagacggtaaagacgcttgaggaacggggattccaggtcaccgtcgcgtcgatgaacgattttaagccgaataatctgaaaaaagtaaacaatttactgatcgtggtgagcacacacggagaaggcgatccgccggataacgcgctggcctttcatgactttcttcacggcagacgcgcgccgaagcttgaagagctccgttactccgttttggcgctcggggacagctcgtatgaatttttctgccagaccggcaaagagtttgacgagcgtcttcaagagctcggcggcacccagcttgcgccgcgggttgattgcgatcttgattatgatgagccgttttcggaatggcttgaagcggtcatcggcggtttgaacgaaggagcgggaaatcaaacagccgaagcgcctgccgagacgcccgctctcggtgaatccgtttattccagaacgaacccgtttcgggcggaggttcttgagaacatcaatctgaacggacgcggttcaaataaagaaacacgtcatctcgagctttcgcttgaagggtcgggcctcgcgtatcagcccggagacagcctcggcatctatccggaaaatgatccggcgctcgttgatgagctgatcaatgagctgaaatggaatccggaacaggaagtggcggtgaataaacaaggagagcgccgtccgctgaaagacgcgcttacttctcattttgaaattaccgtcttaacaaagccgcttttgcaaaaggccgcacagtttatggctgatcaaaagctgagtgaacttctggccgaaggaaacgaagagcagctgaaagcatacaccaacggccgtgatctgcttgatctcgtccgggatttcggtccgtgggaagcttccgcggaagactttctttcgatcctgcgtaaaatgccggcccggctctattcgatcgcaagcagtttagaagcgaatccggaagaggtgcatctgacaatcggagcggtcagatatgacgcgcacggcagagaacgcaaaggcgtctgcagcattctttgtgcggaaagactccagccgggagatacgcttccgatttacattcagcacaaccaaaacttcaagctgccggaaaatccggatacaccgatcattatggtcgggccggggacaggcatcgcaccgttccgttcctttatgcaggagcgtgaagaaaccggagctgaagggaaaacatggctgtttttcggggatcagcactttgtcactgattttctgtaccagacggaatggcaaaaatggctgcaaaacggtgttcttacaaaaatggacgtcgctttttcccgggattcggaggaaaaagtatatgtgcagcaccgcatgaaagaacaaagcaaagagctgtatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagcgattatttgcgcggcacattgaaagaagtcatgctcgaccggatttcagccggcatcccggacgatgacaaccggctgatgaagcatcacggaagctacttgcaggatgaccgcgatctccgtaatgaacgtcaaaaacaaaagcttgaaccggcttatcagttcatgctgcgtgtccggatgccaggcggcgtgtcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgctcgataccattgcggcctgcggagatgtcaaccgaaacgtcatgtgcgcttcaaatccgcaccagtctgaaattcatgcggaagtatacgaatggtcgaagaaattgagcgatgaccttcttccgcgcacgagagcctatcatgaaatctggcttgatgaggaacgtgtggcgggaactcctgacacggaaacggaaccgatgtacgggccgctgtatttgccgaggaaattcaaaatcggaatcgccgtgcctccgtccaatgatatcgatgtcttttctcaagatctcggcttcattgccatcgtggaggaaggccgtcttatcgggttcaacgtggcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcgaaaccttatcattttgaccataacggcgaccgttacggatgggtgaagggcgtaaaagggaaatggcactttacgatgttcatcgaaggcggccgcgtcacggactatgagaattataagctgatgacgggattgcgtgaaatcgccaaagtccatacgggagatttccgtctcacctctaatcaaaacctgattatcggcaatgtctcgagccagaaaaagaaacaaatcagcgcattaatcgaacaatacggtctgacagacggctggcagcattccgccctccgccgcagttcaatggcttgcgtcgcgcttccgacatgcgggctcgccatggccgaagccgagcggtatctgccgaagctgattgataagattgaagacattgttgacgaaaacgggctccgggatgaagaaatcaccatccgtatgaccgggtgcccgaatggctgcgcccgccatgcactcggcgaaatcggatttatcggaaaggcgcccggaaaatataatatgtatttaggagcggcgtttgacggcagccgtttgagcaaaatgtaccgggaaaatatcggtgaagaggaaattctgaatgagcttcgcaccattctcccgcgctacgcgaaagagcgtgaggaaggcgaacacttcggcgatttcgtcatccgcgccggcatcattaaagcgacgacagacggcacgaattttcacgaataagatgagctcttaaaaccaaggatagagacacactggcggtgcgttctctatcctttactaagcagcataaacgctgctccgcgtcatgaaacagatgacgcagcttgcgaaaaagcctgttttcagagaaaacaggctttttctttttccggaaaaaatgtagctgaaggcaaaaaaagttcgccgtgagcgcgttatgagaaattttaaataaaaacgggtaaaataaaaggagaatggttgcgtgcggaaaatatattgaatctgcccgatcatcggctccggcctttgacaagggcagagaacaggcaataatgatatgatgcagcagatgaaggaggtcagctttggacatatttttagtcgtactcgtacttttaaccattatcgcgatctcaaatatcgtaaatcggtttgtcccctttatcccggtgcctctgattcaggtggcgctcggtatcattgcggcgtcatttccgcaggggcttcattttgaactgaatactgaattgttttttgttttgtttatcgcgccgctgctttttaacgatggaaaacggacgccgcgtgcggaactttggaatttaagagcgccgattctgctgcttgcgctcgggcttgtgtttgccacggtgattgtcggcggttacacgattcattggatgattccgagcattccgctggccgccgcgttcgggctggcggcgattctgtcaccgactgatgttgtcgcggtcagcgcgctgtcagggcgtgtgaagatgccaaaaggcattctgcgtctccttgaaggagaagggctgatgaatgacgcatccggcctggtcgcttttaaatttgcgattgcggctgccgtgacgggcgcattttcgctggcgcaagccgcgttcagtttcgttctgatttcagccggcggtttactcagcggtgtcgtcatttcttttttgattatccgtttccggctgtttatgcggcgcctcggcatgcaggatgtcacgatgcatatgctgattcaaattctgacgccgttcgtcatctatctcgcggctgaagaaatcggcgtttccggcattttagcggttgtggccggcggcatcacgcatgcggtggagcaggaccgtcttgaatcaacgatggtcaaactgcaaatcgtctcttcaagtacgtggaatattattttgttcattctgaacggtcttgttttcgttattttaggtgcgcaaataccggatgtggtttccgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggtcacgcttgcgggttccttttccattccttacgtgctctctgacggctcaccgtttcctgaacggaatttgattctctttttagccgcgggcgttattttgtgcacattggtgctggcgacaatcgttctgccgattttgacagataagccggaagacaatgtgaaagaaaagaaagtcaaattgctgacagcgagacggaagctgataaaggctgccttaaccgccattaaagaaaatatgaatgagtcaaacaaaacggcttcttttgcggtcattgccgaatacaatgagaaaatgaaaaatctcaggtttcagcagttcaccgtcaaaaaccgcacgaaaaaagatgagcggaaagtccgcgcccaagggattcaggcagaacaggaagaattgctgcggctgattgagcggggcgacataccggaagaaacggctgacagccttcaggaacggtttgatgaactggaagtgctttatacgaacccgtttaaagtcggcttatctaagaaaaagctgaaacgcctgatgtactggatctttttcggcgaacataaaaaaccggaaatgtcgattttaaatgaagaaggcctcattcgctccacaagggttaaaacggcaaaagcggccattgaaagcctgaaaaaacacatgactgaagaaaataaagatgtgacgcttgccgtcatttccttttacaatcacttgattttcaggctggggcactcgtatcacgaacagagtccgagtcgccgttttgaaaatcaaaaactcgaaatcaaactgcgggccgtgcaggccatccgcaacgaaatccaaacattattcgaagagcgggaaatttcccgcgacatgtcgcatgagcttcgccaatacatcaatgatgtggaagcggccatgcttgacggagatgaataaaaaaagtccggcatctgttcgccggacttttttagattacggacgatggaattcgacgtgatcgccgtcgcggtcaaaccagcctctgaaggcccagttgatccagccgccatctcctttgttggtgaagcttccgtcttcaaacacccaaatgccgtacgtgatgccgtcataaacggcggaaccgtaaaactgaacgccgttaaaatgatcttcatattcctggcttaaattaaacaccatgacattatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgtttgctgagccatgttttgaggggccgggttttcttttgcggatacaaaggacagaggagtcagagacaaagcggcgccaagggcaacggacatcgggatacgcatacgtttcatatgatttcctccttcaattgtgtggtggctacagtagcgatttacccggacagttacctgattaaccgtaatttttgaaaaataggaaaataataacgtcagtggtgcttgggcactaaagatggtttttgtgataacgatgagcgtataattggtttcttacggcggaaatgtgagataataataaccgtttacataatgactagaaaggatggttcaacgtggcaaaaagcttaaaagatactgtaaagcttcataatggcgttgaaatgccgtggttcggccttggcgtcttcaaggtggaaaacggaagcgtagcggcggactccgtcgaagcggcaatcagaaacggctaccgcagcattgatacggcggctatttataaaaatgaagagggtgtcggcgaaggcatcagagctgcgggcgttgccagagaagagctgttcatcacgtcaaaagtgtggaatgaagatcaaggatacgaaacgacacttgacgcgtttgagaaaagccttgagcgcctcggcctcgattacctcgacctttacctgattcactggccgggcaaggataaatataaagacacatggcgcgctcttgaaaagctgtacaaggacggcaaaatccgcgccatcggcgtcagcaacttccaagtgcatcatttagaagaactgctgaaagatgctgaaatcaagccgatggtcaaccagattgaattccacccgcgcctgactcaaaaagaagtaagagatttctgcaaagcgcagggcattcaagtggaagcgtggtctccattgatgcagggacagctcctcgataacgaagtgctgtcacaaattgcggaaaaacataacaaatcggttgctcaagtgattttgcgctgggatcttcagaacgaagtcgttaccattccgaaatcgattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcgtcaggctttggagcgtgcggccgtgctgcaattgatcgaccgtatcaagcacccagcgctgaggcagaaattcggcgattgtctgcactgttttcggcataatattgcccggaaaaaagcagccggcgagcaagcatgtcggtacaacgatcaagttcaaaagcgccgatgccgaagagctgctgttggaaaaaccgacggcaataaaggcgatcccgattgcgcttaatgcaaacagcatcatcaggacgaacagctgccacagcgggaatgacggatgaatatgaaaagcggcgcccataaagagaacggcgaatataatttggacggccatgataatgatattcactgccgcattcgccaatacatactgctttgacgtgatcggcgttgacagaagcctgtagtacgtcctgttttctctctctttaatcatcagttccgtcaggttgccggcggaatagagcataatgataatgagatacccgatgactgagtaagtcatttctttatggttcgaagtatctttcaaaacagcggactccgtttgaatcggagaatgcttgaaatcggcgtacatcgcctgaaaggctttctcgtctccgccggaagatttgccgattgaggcggcgctgttcatataattgtacaaataagagctgacatatccggtgacctgggcgcccttcagcgaggtcatgccgatgtgagacggtttcccgtcttttacgctttgggagaagcctttttcaaacgtaatgagcgcctccatttttcctgaagcgatctttgatgaggcggacgcatccgtttcctccgaaatcttcacatgatccagtccttttaaaaacgtgaccgtatcctgtgccacttctccgccgtcctgatcgagaatgccgatattgagcgtttcggctccgccgttggcattggtcatgaaggagaggaagacgccgatcagcggagccccgatataaagaatgagctgttttttgctttttgtaattcctttgagagtgtgtgcaaacagccaccagaagtttttcatattacagtccctcccgtctttgaaacgtaaatgcggcgatcagcaaaaagagtgccgccaatgctgtatttaaaccgagtgcaggccatgccgctgatacatcatttgcgtaaatgatgttgttaatcgccttattgatccaggataagggcgacagggcggaaatccccctccttcatatttgtaataggcgccgccgataatggacatcacctgcacgatgatgacggtgattaatctggcgctttcgggttttctggtcaaatagctcaggctgagcccgaagctgacggccaaaagaatttcagaaacgagaatcaacagcacaagtcccatgtggctgccccagttcgctttcaagataaatttgctgaaggcgacaacggcaagaatcgtcagaacattcacagccaaaatgccgagcatctttccaagaaagatatcgcttttccggagcggggcggcgatcaggcgatccgcggtgtgccgtattctttccccgcggaataaggagcttgcaaaaatcgaggcgtacagcccgatcatcgtcgtcatggatatcgcgtaaaaatctttcgccttcggttcttttgctttgtgtaaagacgtctgcttcatataatcgcttttgatttgtccggcggaaggtggcttatgcgccttgtaagcggcggcgcctgctttgtattgattggtaaaagcggtcagcatgccttggacgatcgtgccgttgatgccgctccggtcatttgtatagacttgaaaaccggtgttttttacagtgacgaaagcatccgcctgattttcacgaacctcgtttttgccttttgcctccgtgtccgctttttgaaaatagacatgctcttttttggcgtttttcataaactcagtaaagtaatgagaaagtgtcccgtttgattggtccgtatatacgaccttgatgttcccgaccgtcacctctgaatcaaaggcgtttgataatgccgcggtaaaaatcagcatgaagacgatcggaaaagcaagcatgaaaataaaagtccgtctgtcgcggaaactgattttgatttctttcccggcgatgtgcagaatattcatttgcaatcctcctttcaatagggtcagtcgcgcagacttctgcctgtcagcgtgagaaataccgtttctaagtcaggtgcctgttcctgcaaggagcggatttcaatgcctttgtccatgaagtaccggatcaggcggtttaaattgttgacccctgtgtcagagctgattttcacgctgttttcttccagtgcggcggctctgacgccgggcagctcctgaatatcgccgaggctgatgccgtttccggatgacagctcaatcacgacgtccttcgtgtcggtaatgatggaggtcagctgttcttttgtgccttcggcgatgacttttccgtggtcgatgatggcgatgcgtgtgcatatttcttccacttcctccatgtagtggctcgtgtaaatgatcgtgcagcccatttcattgagctttttcactgattgcagaatataatttcttgattgcggatcaatgccgaccgtcggttcatccatgatgatcagtttcggccggtgggcaagggcgcaggcgatattaagccggcgtttcattcccccggaaaaatgcttcggcaaatatttgtgtttatcgctcaagccgacgaatgtcagggcttcctcgacccgttctttcagagccgcccctctcaggccgtacagacctgcgaagaacttcacattttcataggcgtttaattcctcgtaaatcgcgaggtcctgagggacgatgccgatattcattttcgttgctttgctatatttgaaaatatcttttccgagaaacagaatgtctccgcctgaaggttttaaaagacctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaggacggccgcccgttcttccataccgagcatgccgaggccttttttaaagcggacggcgccgtttccgttatctttcacttccgctttcacggctttattcagcacatggatatcaatgaaaatctgcgtggcatcggcgtatttcatcgcattggttaaagcttcggttacgttttcctgaatgactctccaatgcatttgcgtcagcctgtccaaatcgccttgatgcgtaaacggaaccggcatcccgtttttggccgaaaattcatcaataaacgttcttaatctgtgaatgcccatttgttcagcgggcggtttcatatttttcagcgttatgcggatatcctctatgccctctttggaaatggtaatggcgttttggagcagttcagccgctttgtccggatgggagccgagcatccgcttcgccgcttccatctgaatgagcgcgccggtcatcgaatggccgattttgtcatggatggcttgggacaatctgtttctttcctcgagtttgccggtgtactccgattgtttgatatattctgtgctgctgtgcagctgtttcgtcagtttttcaatgcttgagcgcatgctgtccgactgttcttcatatttcttcagccgattgccggaccgggcggccaaaacgaaaatcgccagacagaacaaggttatgacgatataagtcggaaggtcgccgtacgggataaataaaaacggcaaaaacacgagcaggcagaacacatagcggtgaaccggatattcggcaagaaccgcaaaaatggcgggcggcaaaagaaacagaaacgccggatggcctaaggcggaaagccaagcggtcaatgccagcgtcatgagggtgatcccgcgcctccaagcgggcggcctgatcatgcagaccgcgatgcccaaagacagataaagcagcagaaataagacggcgtacggcgtgtaagggcggtctaccgatacgaacaaaaaagccgtataaaaaatagcgatcagtctgctcatcagcatccaaaaatccataccgttcaacgcccgttatccaccttcccggtgatataaaaaatggcgatctgcgttctgtgctcaagccccgttttccctaaaatagatgaaatataattggccgtcgtcccttcagaaatgaaaagctgttttgaaatttccctgttcgagaatcctttcgcaataagcgacatgatgctgagctctctttcagtaaactggctttcatcaatctgatgcgcggcttccgccggccggaaaaggctgtcttttattttgtccagcacggtgtcctgaagaatgctgtgcccgttgaaaacgcttttgatcgcatcgcggatccgttccggttcggtgttttttaataaatatcctttcgcgccgtttttaattgcttctaaaatatactcatcgtcgtcaaatgtcgtcaggatcatcggcttcgtatccgtttcctcagcgatccgttttgcggcttcgacgccgttcatcaccggcatgcggacgtccagcaaggcgatatcgacggggttgtgcttacaatactctgccgcctcgagtccgttttccaacgttgctgatacagtaaattcctcatatgtatgcaaaatgattttcattccttctctgatgaaagaattatcatccgcgataatgacattaatcttcatagccgcaccctttgtgtgtttttgtttcattatataccatccgattttaaatcaaaaagcctcccggcgaaaggtgcgcggaaggcagatcggtcaagcgggctttttcaattggatgaaaaacagcatcagaaaagaaatgatcacaatacagatcacccacacccaggcgagtgtttcattgccggagtccatcgcgacgtaaatcgccgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccacctgccggctccgtctactttcgccgctccctcgatgtcagcatcaaccgcggcgaagccggttttagcggactgatacataagcgggaaggcgacaatggccgaagcgatcaccgcggccgaccacgtgaaaatgacgggctggtgaaaaatccgctcaatcgcccggccgataaagctgtgtttcccgaaaatgataatgagaatgaagccgacaacggtaggcggaagaacgagcgggagcataaacagggtctccacagccgtttttccgggaaatcgcgctttcgccatccaggcgccggcaagcgttccgagaatgatgacggcgatgcccgacgccaaagccacctcaaatgacagtacgacgggagtgaaaaactccgaagccgtaatgttacttggcagtaaatccatatttcttaaacactttcatcgcttcatctgactgcagatactgataaaacgcttctgcttctttacggtgctttgtatccttgacgatgccgacaggatacacgatcggatcgtgcgttttcgccggtgcttcatcggtgattttcacctttttcgaaatcagcgcgtctgttttatagacaagcccggcatcgacatttccggtttcaacataagaaagcacctggcggacgtcttttgcatagacggctttatcttttaccttgtcccacagggataatgccgtcagtgactgtttggcgtattgtccggccggaacggattcaggcgtgccgagcgcgattttttccgtgctgtcttttttcaggtcattcagatgtgtcaggtgtgcgctgtttttctcaggcacgatcatgacgagatcatttttcaaaagatccgtgctgtcctttttgtcgatatctccgtcatgaacgagcttttcgaatttatcttcggctgccgagaagaataaatcagctcccgcgccttgtgaaatttgtttttgcaatgtgcctgatgatccgaagttgtcttgaatggttacgtttgaatgtgatttttcgtagttggtctggatttcttcaagtgcatcctgagcgctggctgctgcagaaacggtcagcgtgacgttttcgttttgtccgcctttggacgattgtccggatgagcagcccgcagttgcgaggaaaacggccatagccgcagttgtgagtagtgtcgctttctttttcaacattgtgcaccccttatagctaaatatcattagatcaaactaattataacgcaattgtacgtgatggtgcggttttttttcaatatctgaacagttataataaaaacggagcgtgataatatgacagaagccacttcctatacaatagaagaagttgcgggccttttgaaggtctccaaactgacagtatatgatttgataaaaaaaggactcattccggcgtacagggtcggaagacagatgagggtcgatgaagaggacttaaaacaatataaagcaaacatgagaatgtcaaaaaagccatccgcagcagaagcgcctgacccgtcacgcgggcgggagccggaaaaaaggcagtctgttatcatcagcgggcaggatgtgtcgatggacctcctcagcaaacagctggaacaaacaatacaggcggctccgctccgcaagtacagcggcagtttgaacagcctgatcgagatgtaccgcggggcttgtgacatcgtcagtctgcatttatacgatggggagacggggcagtataacatcccgtatgtgaagcgcattctttcaggggagccgtttgcgctttttcatgtcgtgctgcggcaggccggattatatgtgaaaaagggcaatccgctgaacattcagggctttcaggacatgagccgaaaggatgtccgcatcgtcaatcgcgaaaaaggatcaggcgcgagggtgctgctggatgaacagctcagatcattcggcatcacgccgtctgatgtcgccggatatcatgacattgtcacggatcatctgtcagcggcttcacaagtatcaagcggaaaggcggatatcggagtcgggtcgctgcatgcggcgcatatggcaggcacggactttatcccggtgatcagtgagcagtacgatgtggtcgtcttaaaacaaaaccgggagcttgttcaaagcgtgcgggacattcttaattctgaggaattcaagtctcagctttctcaattatccggatatgatacgaaaatgacaggacggctcatatatgaaacatgaaaaatccctccatataacggagggatttttttattgcttataaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatggtcatccgtgataaagctgccgtttctcagcaccgcaaacggagtccgctctccggaaaacagatcattgccgaactgaatgctgcctttcgtttcaatgccgagcaggtgaagcagcgtcggccttacatcaacctgtcccgcggccgaagcaatcgtttccggcgcacggtcggtcaccccgggaatatgaatgataaacggcacgcgctgaagctgaaccgtatcaaacggagtgatttcctctttccctaagaattcggcaagtccttgattatgggcttcggatataccgtaatgatctcccatcaggacgatcatcgcgttgtcatacagcccttcttttttcagcttcttgaaaaagtgtttcagagcctcatcttcatagcggaccgtcgtcacatagcggtttaataactcgctgcttgtgtccggttcctcaatgagctgatcctgttgatcaatttcaaaagggaaatggttggtcaaagtcagcaggcttgcgtaaaacggctgcggaagcttctttaatttttccgctgactgttcgagaaactccttatccttcaggccccagcctgttgaattttcctgtgtcaccttaaattcatccgcgtcgaaaaaacggtcgattccgaatgccccgtacatctcatcccggttccaaaaggctttatgattggcatgcagaacggctgaatagtattgacggtcttttaacatatggtacatcgtattgaaccggtggccgctttttgtgaaaaaaacggcgccgcttgaagacggatacagcgaattcgcagtaatgaattctgaatctgatgtttttccctgttcagtctgctgataaaaatgagtgaagtcataacttttttttcgcagtttgtttaaaaacggggtaatctcccgtccgctgacccgctcatccattacaaaacgctgtgttgattcgagcgtaacaaagatcacattgcgcccctttgcaagcccgaattttgaatcggacggcctgctgtagccggcttgagtgtaattcgcgaccgccgcaaggctgtcttcatcggcaaacgctttagcccctgcattcagcgtctgcgaaatggtgtcatacaaatgaaagtggaacaggccgattccttttacgagcgcttcacgatcaaaagggtgcttgaacagcttcggctgctcggcctcagacagcgcaaggttgcacagcatgaggccggctgatgcccacgcatacgctttaacggtacgggcgcccgcttttcctttatcggctttatgcctttttccaagataaaacaaaatcgcaatatccaaaaataaagcgatataaagcgggtgaaacagctcttggacgctgcttcccatatcacccatattgcttgcctgaaacaaaaccggtatggtgataaaatcaatataaaacccgtaaaacaccgtattcgcgattaaaattcccgtcagcatcacatttgccgaaagcagaaagatccgctgttttttttccgtcagcaagagggcgatgccgaacagcggcacaatgaagctcagcggattaataaggagcagacattcctcaagaaccgaattgttctgcagaccgaaaccgagcttatacacggcataggttttcatccacatgaacaggatggacaggcataaaaaccgatgattgctgaaaaaggttttcttcatatgtatgactcctcaccctaaaagcgaaaagacgctttttgtttaagagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagtacaagatggcttgccattccgatcatcagtccggcggaaatgctcggattcggaatataggttgccgtaatgaaaaacataataagcataaacagcaggctgtgtgtaaacgttctgtgcccgaacaccgtgcttacgactttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtacctatatttgataaagaggtgatacagatggctttctttaacaaagaaaaaggaaaaaacagcgataaaaacaaaaacgtcattcaaggcgcgcttgacgacgccagtgcagctctgaaagacgatccgcttcaagaagctgttcaaaagaaaaaaaacaaccgctgaccatataagacgggtagggcgaacgctctatccgttttccatctaatatttccctttgacagatctttttatctctgataacctctgagtagaattgaatgataaaaatcctcactctttctcggtgaggtagaggttgcgcttgatgatgagtcgcacatgccaggctgataaggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggctttttttgcgtgtaaatatggtctcggggtctggtccgtacgaatgaacaaccaggaggtacaggaatggaacagacgaaaaaatggggtttttggttattaacggcgtttgtcgtaggaaatatggtaggctcgggcatcttttcgctcccgagtacgctcgcaaaaatcgcgagcccgttcggcgccacatcggcatggcttttaacgggagccggtgtgttaatgatcgcgctggtcttcggccacttatccatccgcaagcctgagctgacggcggggccgcaaagctatgcgcgtgcgctgttcagcgatcggaaaaaagggaatgctgcgggcttcacgatggtgtggggctactgggtggcgagctggatcagcaacgtggcgatcatcacgagccttgccggatatttaacatcatttttcccgattttaacggataagcgtgaaatgttttcgatcggcggtcaggcggttacgctcggccagctgctgacgtttgccgtatgtacggttttattatggggcactcacacgatcctcgtcaccagcattaacggtgcgagtaaattaaatttcgtcacgacgttttcaaaagtattaggatttatcttctttatcattgcaggtttgtttgtatttcaaacgtcgtttttcgatcatttttattttcctgttcaaacaggtcctcacacggttgagggaatcggcggacagatccacaatgcggcgatttcaacattatgggcgttcgtcggaattgaatcggcagtcattttatccgggcgcgcccgttcgcagcgcgacgtgaaacgcgccaccattaccggattattgatcgcgcttggcatctatatcatcgtgacattgattacgatgggcgtgcttccgcatggtaagcttgtcggctcggaaaaaccgtttgttgacgtattgtacgcgatcgtcggcagcgcgggaagcgtcatcatggcgattctggcaattttgtgtctgttcggaacgatgctcggctggattcttctcggttctgaagttccgtatcaagcggcgaaatcaggagactttcccgctgcttttgcaaaaacgaataaacagggaagcccggttgtgtcgttaatcgtaacgaacgtaatgtcacagatctttatcttttcggttatttcccggacgatcagtgacgcgtttacgtttttaacgacggcggcgacgctcgcttatctgattccgtatctcgtgtcagcgttttacagcctgaagctcatttttacgggtgaaacgtatgacgagataaagggttcaagagtaagagacggtatcatcgccatccttgcctgcatttattctttttacgtcattattaccggaacggccgatttaacgacctttattctcggtatcgggctgtttttcgtcggtttgctgttatatcctttcgtctcaaagaaatttgcaaacaacagaccatcggtatgacaaaaagacatctcacgtctgtgagatgtctttttttgtttgcaacagcggattactttttgacggcgtgtatataatgaatggtctcaaatgcggttaaatggtcagtgcgtccgctgaaaaaacggtcattgacgtccgccggagatacatgttcataaataagcagacctgatgattctaatattttttcgatttctttataactgaaacacgataacatcggttctccgcctgctgcagccattttcaccatgttttccactctgtttgacagtcctctttcttcaaagagcgactcatctgcataatcaaacacgatagagcttcccggcgggacttcggcaaataattgtgtgagcaggcgggcgagatgctctttcgtaaggtagtatgacacaccgagcaggctgaaaaaggttttttggcgtgaaaaaccttcctgatacagacggctgaaagaaagcgaagcggcgaagtccatcggtacaaaatgaagatgatgggaaatgtcgagattcagatgtttcaatctgtttattttgtcttcctgtgaagcgggatgatcaatttcaaatatgtctaagacgtttgtcatctcaggatgcctgaaacagaaagtatcgagccccgcgccaaggataacatactgtttggccccgagcttcacttcattcaaaagcacttcttcacaatatgcggcacgggctaacggtgtaggagacagctgtacttgagtcacccattttaagatgtcatccggttggccttgaagcctctgtgccatgtctttactgaaaaatgatataccttgaatcagatgatcgcggatgtccgaatgctctttttcggaaatcagatcttgtgccataaaatcatcaaatatcaccggggtgtcgtatttactgtggtacgcccttccgaaagcggacagcagggaagtcatactcgccttgttttctttcatataaagatcctccgttatttacatcaatctccggccgggagaatcttattatacatgttaatccaaaaatgtaaattataacataaataaatttttttgtcaagttttaagcgtaataaaaagccgctgtgacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggcccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgagccgaccgctttttgaacctttgttttagcggcagcggttttcttatcccattcagccagccatttgtctgctttatcttcagtgcctgtcattttcgcaaactctttgaattgatcaatgttgctgagcttgtcatatttaatggcgatggtcggcgcgattttttccagtttttcaatatcggcgccttgtgtcgtccagacaacgattaaatccggctttaagtcaatgattttttcaacggacgtgccgtcgccgatgtttgtgacaccttttgttttccctttgtaataagggtttttaaatacgttttgcggcgcgccgacaacattgatgccgagctgtttaaagtcgccgtagtagccgtcagccatgacgacgacccgtttcgggtgcttcggaattttaatattgccgttttcggctttatacgtgatggtttcttctttttcagaagaaccttttgtgtctgaagaattgccgcatgcggccaaagcggcgaagagcagcacggcaatcagcgctgcgccgattttcttgtatgtatggaacatctgacattccttctttcataaaaattagtgataaagagaatcattatcagtgtgattatatcactgctttcatagagaagcacgctctttttaaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctcaaggggcatcagggagtgaaatccagtggacggcgcgttcattccgggctgctgtgctgctgtgtgccggtattgcggttttattgatcggcgccgctctgtctgtttccatcggagctgccgatattcatctgcggacggtgtgggatgctctctttcactttcagccgcaaaatacatctcatcaaatcatacgcgatctgaggctgccgagaaccgccgccgccgcgctcgtcggggcttttttagctgtgtccggagcgattatgcaggggctgacgcggaacccgcttgctgagccttccattatgggcgtgacgtcggggtcaggatttgcgatcgcattggcatttgctttttttccgggtctgtctgcggcgggacttgttttgtggtcctttacgggagcgggaatcggagcgcttattgtgtttggcatcggcctgtcttcaaaaggcggtctgacaccggtgaagctcgcgctggccggtacggcagtcggctatttcttaacggggctttcaagcgcgattgcgatccgttttgatgtcgcccaggatgtgaagttctggtatgccggaggagtcgcttccgtcaaatgggaaggcatgcagctgcttttggcggtcggggttatcggactattgctggcatttctgattgcgcgctcagtgacggtgctgagcttgggtgaggaactggccaaagggctcgggcagtacacatcgcttgtgaaagtaatcggaatgtttgtcgttgtcctcttgacgggggcttcagtctcagtcgccggagccatttcttttatcggcttggtgattccgcatatcacccgatttttagtcggggtagattacaggtggatcattccctgttcggcggtattcggcgccgttctgttagtcttcagtgatattgccgcaagactcgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttgtgctcatatgcatcgtcttttttatcagcttaaacatgggtgtgatccggattgcgccacttgatacgatgcgtgtctttttcggacagggggatgcccgggatcagctcgttttatttgaattcagactgccgcgcatggtgctgtcattgcttgtcggcgcaggaatcgcggtttcaggcgcgatttttcaaagcgtgtctcaaaatgacttggcggagccgggcattctcggtattaacgccggggcgtctttggcggtcgttctgtttatcttctttttccaagggtcagctgttgatctaagcatggccagtacatggctgcttccggtgagcgctttggcgggggcttttctggctgcgctgctcatctatgtgctggcttggaaaaaaggcgtttcacctgtccggctcgttttggtcgggatcggtgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgctccagctcggtgatcagctggcggcggggcttggcaccaaggttgaaaaggagcggcgcgttctgctgatgtccgccgttgccctgaccgcgtcatgtgttgcggcagccggcggaatcgcttttctcggactcattgcgccgcatttggccagaaggcttaccgggccgcgccaccagacgcttatcccggtttcagctttgatcggagcatttttatttctgcttgccgatacgctggcgagaaatgtgcttgcaccgtccgaagttcccgtcggcctggtgatttccgtgctcggagcgccgtattttgtatatttgctgatgaaaacgaaatagaggaaggagactgccgcgatgaactcattatcggcggaacagcttactgtcggttatggcgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaggacatcgccaaggaaatggcaattcttccgcagacgcctgaagcgccgagcgggctgacggtgtacgaacttgtttcttacggcaggtttccgcatcagtccggaatgggccgcttgagtgataaagaccgtgacatgatcaaatgggcgcttgaagagacggggatggccgaattttacgaccggccgatcgaagcgctttccggggggcagcggcagcgtgtgtggatcgccatggcgctcgctcaagaaacggagctgctgcttcttgatgaaccgaccacttatttagatctcgcccatcagcttgaaattttgcagctgctggacaaattaaacaaggagcagggccgcaccattttaatggtcattcatgatctgaaccatgccgcccgtttttcccattacatgatcgcgctgaaaaaagggcgcgtcatcaaggaaggaacggcggaggaagtcatgactcccggtatattggaagacgtgtttcaaattgacgcacagattgtaaaagatccgcgcacgaacaaaccggtctgcttaacctacgatttaatccggcatgaaaacgcaactgtaagatgaaaaaaaacgcagagccattccggcctgcgtttttttagtgcgcccggggctgcttttgtccggagacgcatttatccaaaacgaaaaaaacccccgccacaatcagctcctccgtcgttgacagccaaatcttttcaatcagtttatccgtcgtatacgcagtcatccagaggaacagcagctgaacggtgccggctaaaaggagaaaaggcagcctgcccgtcccaaaaaaggtaaagctatgtatcatcagccgttcaagcggttcaaaacataaaccgagaagaataaaaagcacggaaaaaagcaggacgtacgccatcgatccgtagctcgtcccggctaatgaaaatacggccatcatcacgatgaaatacccgaataatacggcagcggctgccagggcataccggagcacctgaagaaaaaacattttcgtcccgttttgattgatcatctgttcagctccttttcacacagaggagacttgcagagacggaactctgcaagtcgggtgtgtatcttcagcatttctttttgacgacagggtgtttctctttcgaaagaatatccgtaaagtctttgcccagatccagatgctgctggacgaatttctcaggaagcatggcaagccattggttcagggacacatcggcatagtggtcatccttgaagatttccaggaagacgagcggctcatcccccaaattctccacatagtggcccattgcgaacgggacgtaaccgacatccccggcctgatagttaaatgttcttgcatggccgtccgatgcaaaaaccgtcatccgtcctttaccggaaatataatactgccattcatgcgtattcggatgccagtgcagctctctcattgcgcccggttcgaccacgacaagcgctgaagcgatcgttttggacactttgaagtttgtggaatccgcgatatatactttgccgccttccgtctcagcagtcggaccttcatcgagcaggcggtaagtgaacggataaggcacttcgccgttcgggccttccacaatgtcgtctttcagcttcccgggaaccggctcttcaaagatgtatttttctttccgaggcaggccggcgaggtctttttctgaaaccccgaaattgttggcgatgacatcaagcggcgtgtgggcaagccagtcagtcacttggaatgtgctgttttctgagaaggaaccgtcatcaaaaaccaagaggaattcacagccttctttcagcgcctgaatggagtgcggcaggcctgacgggaagtaccacagatctccttccttcacgtcatcgataaaactgcgtccctgttcatcaacgatcgtgacccgcgctttgcccgtcagcatatatgcccattcggcttctttatgccagtgcagttcacggatggcgcccggttttaaacgcatgttgacagatgccagattttcagaaatcggcagctcgcgaacggtcacctcacgcgcgtacccgcccttttccagccggttatgcacatctgagaaagagaatttcatattatccactgtgccgtgatccgtttccggcggcgtcagcatatccggattttggcggtctctttcaagattgcgcggaatcgtgacggtcgctcctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgtgtgaaaattaatttttcattttctgatctttcagttccgtcatcagttcgatcagggcgtcaaacttcttctcaaaccgtgtgagaagatacatagcaatcagagccggaaagccgagattgccgatctgtctgaccgcttcttctataaaaacctgatccattgtcagccacctcctgacttgacctgcagtcatgtatataagtgaaagaaagagcggctcctgtaaacctgatatcccggttgagggtctttttttttgttccggcaaatccgggacataaggaatgcggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcattggacgaccattttaaacagttttataaggaaatccggatcatcaaatatatgaactctatgatccggattttctccatcgattttgacaagcgcatccgtaaaaatcagaatcgctatccgctgacggtggatcagccggagggaggtgaagcgcttccctatgaaatgggaaaagacgcgtatgaagagtttctgcggaagcagggagatttgagccagcatgtccaaaaccgtgatttatacgaagcgcttcagacgttaaccgataaacaaaaaagcgtgctgacgaatatttatcttcacggagcgacgatgaaagagattgccgagtcgctgggtgaatcacggcagaacatttccaatattcataaaaaagggctcgacaatctcagaaagcagctggacaagcaaaaaaagggggaaaataagcagtgaacgggccatttgacttcaacaaagagaacacagataccgacgaaatggaacttttgatttcacgtttttcgccaatgataaaaaaaaaactgagcaatacatcataccaggaaagagaagaccttgaacaagaattgaagattaaaatagttgaaaaagcggacatgctgttatgccaggaagtgccgggtttttgggaatttattcttcatcttataaatgaaagctcctgacaaaagcggcggaatgatggatattccgctctgacaacgtgagaaaaacgagaagagatgtccgtctcgtttttcttttctgtttccccgcaagacctccgcactaaaaaggtaccaaatcttatccatataatgatatgatgaaaaaaacaaagagaaaggaacgtccaaggtggaaaatgcgtcaattttaattgtagacgatgagaaggcgatcgttgatatggtcaaacgcgttctcgtcaaagaaggctatcacaacattaagacagccggaagcgctgaggaagcgattgagtttgttaaacatgaaaccgcggatctgctcgtgctggatgtgatgatggaaggcatgtccggttttgaagcatgcaccgaaatccggaattataccgacgctccgatcttttttctgactgcccgttcttctgatgcggataagctgtcaggatttgcattgggagctgacgattatataacaaagccgtttaatccgctcgaattggcggcgcggatcagagcgacgttaaaaagaacctataagcgcgaagagaaaacggcggtaaaaacgtattcatacagccatttttcctattcgccgcaaaacgccgagctgatcgtcgggggcgagcccgtcagctgctccgcacagcttctgcaattgcttcaatatttctgtgaacaccctgatgtggtgctctcaaaagatcagatctatgaaaaagtgtggggatatccgtcttacggcgataacaacaccgtcatggtgcatatccgcaagctcagagaaaagattgaaaaagaccccagcaatccgtcttatattgtaacggtgcgcggcctcggctatcggtttattcccgatcaaggagaaaaaggaatccgctcatgagaatgcgcggaaaatttctgctccactttttcggacagcttctgcttgtcatcctgctgatgtccgttttggccgtcgcttctttcttctatttggattggcgtttcagcgaagcggaagccaatgcgggactgaccaaagcgacggcagactcgtttgaagcgtggcttgataaaaacgaagacggcacatgggatgtcgatgaatttttaaagatgtcggtcagaaagcagaagggctggctgcagatcattaatgacaaagaaaaaacggactacgcatacagagtgccgaaagacgtcccgagccattacagcagaaaagacctcttatccatttaccagtaccggaattttgacaactacaagctgaattactggacggtcacgataaatgatgagacctatttgattctgttcggctggaaatccgccagtgagcagcttctcacttacatcgaatcacaggagccatccctcgcttccctttctcaatataaaaaaagcacggttgattatattaaacgggaaaaaggggcggtctaccttctcgaaaacagcggcagactgctcggggatatcaacagcacgaaaaaagaacggaacaccgtcaatgagcttgaattgctgaaatacagttccaagccgtggaattacaaacgggaaatttcttttaaaagactcgataaaacgaaatggatggtcgcgtcggtgccgaaccccgtgtacatccccgatcacgagtttaacaaatcatttttgagaaatgtgatgaaaaccctcttcctcttgatcggaatcttagtatttatgatctgcatcctgaccatctggtactctttccgtttcggctggccgctgtttcataccatcaaatggcttgtcaatttatcaaagggccggcttgaagagccgaagaaccgcaaaggacagccggtcagcaaaaacaaaaaaggcaaaacaaaacagccgttccgctttttcgccgagattttcgaatcgatggatcagctgaccgacacgctgaagcgggataagaaaaacagagaaaaaatccaggcgacaagggaagaatggatcgccgggctgagccatgacttaaaaaccccgctgagcacgatttacggctacagcatgatgcttgaatcgaagcaatacgactggacaccggaagaagtcaaagaaatggggcagatcgtccgggaaaaatcagaatatatgtctaagctgattgaggacttaaacttaacataccgcctcaaaaacgcggccctcccgatcgaacggcggctgatcaacgtcgtgccgtttatcagaaacgtcacgaacgattttacgaaaaacacgttctcggaaggctatgacatcgcctttgaaaccaaaaaggaagacattcttttcgccattgatgaagcgtggttccgccgtattctggagaatctgctggcaaacgcggttaagcataataagaaggggaccgccattcgggtggtgcttgaggaatcagccgaacagctcattctgaaggtgaaagataacggaagaggaatggacgatgaaacgattcaccagctgtttaaccgttattaccggggaacgaatacgaaggggccgtcagaaggaacgggactcgggctcgccattgccaaagagctggttcaccttcataacggaaccatccatgtcaacagcagaatcagcgccggaacggtgattacgattctttttaaaaaagattgagtttggacgccgctttgtcgggaataacaatagaagactgacaagcaaaagaggtgttcacacatggaagcagcattacgagcagatacgagagcagttatcggagaaggccctttatgggacaaggataaggaatgcctgtactgggtggatatactgggcagccagctccatatcttcactccggctgacggaatcaaccgttccgttaaattcaactcatttgtcacggctctggccttgtattcaaaggaagagctggtgatgacgatgaaagacgggttttacctgtacaatctgcgggaagacacattgacgaagatgaagcagccgaaagacatgcgggaagatatccgtttcaatgacgcaaaatgcgacccgtccggcagattatgggcgggaacgacgagcatggaaggcaaagaagaggaggcttcgctgtaccgtctgaatacggacggcagccttgccaaaataaaagaccaggtctccacctcgaacggtttggattgggatcgggaccgaaacctgatgtactatattgatactccgacgcaggaaatcgtctgttatgcatatgatcctgaaaccggagccgtatcagatccgaaaacggtctaccgctttccggagtcgcaaggatctcccgacggaatgaccattgaccgtgacggaatgctgtgggtggctctgttcggaggcggccgcgccgtccggattgacccgtttttgcataaggaaattgcatctatcgaagttccggcgaaatacgtcacctgctgcgcgttcggaggcagcaatttgaacacgttatacattacgaccgcgacggaaaaattgacggaagccgaaagacttgagcagccgcatgcgggcggcctgttttcagcagagcttgagacgggcggctgggagccggttccgtttgcaggcatgatgtaaaaaaaagccctggcatatggggaagttccccttgtgccgggcttttttgtgttaaatggagcggatgatgccgccttcaacccgctgtgcggtgccgttaatggcagaagcagctgatgaagcgagaaatacaatcgtattggcgacttcttccggggttgcatagcgctgaatcaaagatgtcggttcattcactttaaaataatcccggacgaagctgtccgtgtcttctccggcagcctttgcggctccttccatgtaagaagcgacgccttcggtccatgtcggtcccggcagcacggagttgaccgtgacattcgtgcctttcgtcatttccgccattccccgggacaagctgattaacgccgttttcgtcattgaatacggaatcatttgcgcaagcggtttgactccggcttcactggagatgttcaaaatccgtccgctgtttctttcaagcatttgcggcagaaaacgccggcacaggcgcacggcgctcataacattcacttcaaaataccgagtccattcgtcatcagacacctcagcgaagtcctttacttcaaaaaaaccgagattattgacgagaatatcgacttccccgattccgccggcgcgcttgatcaggtcatccgcctcatcctgacgcgataaatccgcagcgatgccgtgaaccgttccgtaagcggaaagctcctcaaccgtccgttccacggtttctttttttcttccgtttacaatcacctcggcgccttcggctaaaaagctttttgccgcggcttttccgatccctgaagttgatcctgtaatcaatacgagctttcgttcaagctgtaattccatgataatcctccttattacaccattgtgtaacagtatacatgatgaattttagtgtgtacgaacaatttgctttcatgcaaaaaggccggatatacaagccttaaagacttatagtataattactgcgaaaaaaggatacgaatgtcaaagagacaatcgtttaccataatcagggggagttaaaagaatgaagaagatcactgccgtctgggcggcgctcttggtcaccgcctttgtgatcgccggctgttccggcgcacaggaagaaggaagcgcggccaaacaaaaagccgtctcaaccgaagcattcccggtaaccattaaggatgccgcgaacgaaaaagtaaccataaagcaggcaccggaaaaaatcgtttccctcatgccgagcaatacggaaattacatacgcgctcggactgggagataaggtcgcaggcgtcacgacaaatgatacatatccgaaagaagccgtaaaaaaaccgaaagtcggagatatgaatgtgaacgctgaaaaagtcatcgcgctgaagccggatctcgtgcttgcccacgcgtcctctatgtccgcttccgccgatgcgatgaagcagctgaaagatgcgggcatcaccgtcttaacggtcaatgatgcgcaatcgttccaagatgtgtacaaatcaatcagcatgatcggaaaagcggccggcaaagaaaagcaggcggatcagctgatccaatcgatgaaatccgacctttccggcatagaaaagaaagcggcggccatttctgaaaaagacgaaaagaaagtattcgtcgaagtgtctcctgacggctacacgacggggaaagacacgtttatgaacgaaatgcttgaagatatacatgcgaaaaacgccgccggcagccagaccggctgggtgcagctgacggatgaagcgattgtcaaaatgaatccggacgttatcatcacgacagacggcgtaaaggccgctgaagtggaaaaacgcgccggctggggtgccgtcaatgcggtcaaacaccacaatgtctattctgttgatcctgaccttgtcacacgctcaggcccgcgccttgtcaaaggggtcgagaagcttgcagaaagcgtttatcctgaaacgtttaaaaagtaaccgcccgctggcctacacggtcagcctgctgtttttagccgtttgtacggcactcggcatttcaatcggcagtctgcatattcctttatccgacgttttttggatcgggatcggccggacatcctctgttgatcccatgaatgtaaatattatgatcaatatccgcctgccgagagtcgttctggccgctcttgtcggagccgcgctatccattgcgggggcggcgtttcagggacttctgaaaaatccgctcgccgacccttatacactcggggtatcttcgggagcctcggcgggagccgttatcaccttgtttttcggcattcagattcccgtcatcggccggttcacacttccggttgtcagcatcgccgctgccattgcggttatggcggcggttctgtttttcagccgcctcgttcatgcgtcgatgtcggtttcgacgctcattttgacaggcatcattatgaattcttttctcggggctctcatttcgcttgtgattgctttaacgggaaatgatctgctcccgattgtccgctggctgttgggaagcgtgtcaatgaggggctggggctatgtcgcgctgtttctgcctttttttctggccgggacggcgcttctgcttatcaatggcagagaattaaacattatgacttatggagaagaaaaggcaaagctgttaggcgtcagtacgggaaaaagaaaactgctgatgatcgccgccggatctctgttgacgggaggagcggttgccgtctcggggacgatcgggtttgtcggccttgtcattccccacgtgacacggcttttgtggggacggatcatcgccatttactgccgctgtcagcattgacgggcgccgggtttctcattttggcggatttgttttcccgcaccgttattgagcctgtcgaattgccgatcggcattatgacggctttggcgggagcgcctgtgtttgccttgattctgcttcgccagcatcatggagggaaacgcttatgatcagggtgagcagcctgtccggcgggtacggaggccggatgattgtagaagatgtcagttttaccgccggaaaaggtgaatttgtcggcatactcggtccgaacggctcgggaaaaacaacgctgatgaaattgctgacgggaatgctctctccgtcaaagggcgaggtgctcgtcgcaggcaggcccgcgggcagatacaagccgcgggagcttgcgaaaattatggccgttttgccgcagcatacggagcaagcttttacatttaccgttaaggaaacggtgtccttcggcagatacccgtatcaaaaaggactcttcagacagatggatcaacatgacgaagacattgtccgggaagcaatggaaatgacgggcatcgaccgatatgcacagcaatccgtccgcaatctgagcggaggggagcggcagcgcgtctatctggcgcaggcgctggctcagcagcctgaggtgctgtgtctggatgagccgacgacctttcttgatctcaaatatcaaaaagacctgcttgatacggtgaagcggctgacgagagaaagaggcctgacggtcatcagtatttttcacgacctcaacgtcgcaagccaatattgtgatcagctcctgatgatgaaagacggacgcgcttttccgaagcagccaccggatcaggctttgaaaaaagagacgattgaagacatttacggcattaccgtcagcgctgttgcccggcaatcgtcgccgaaaccgctgatcgctttcatgccggaagcgcgggaggaaagagagcccgccggcgttccgttcgcctctctgataaacaaaagcggaaataccgtaacgcttcatacagaacggccgtttagaatgctgtcaaccgcatctgacggcccgggcttttcgtggagccgccggctttccggctcggcggcagctggtttgatctgccgtacgtttgattcggttacgatagccgtgactgcgcagtataccgtttgggtgctgatcagcggacgtttatcggaacagggatttgttcggctgttaacggcagcggctgaagcgagaatgcaggctctttccggcagactggcaaaaggcgacattgccatttgtgccttgcagacaggagaggcaatggacgtccctcacgcggaaagagccgtcagaagaggaaccgcggtatgtgtaaaagcggcggaagaaggaggaatacaacaatgaagctttatacgaaaaccggcgataaaggacagacaagcctgatcggcggcagaacggataaagacagtctgcgggttgaaagctacgggacgatcgatgagctgaacagctttatcgggcttgcgcttgcggagctagataattgtgagaattgcggtgatgtgaaagccgaactccgaaacattcagcatgagctgtttgactgcggcggcgacttggcgacggtcactgaacatagaagctatacattaagagagacatctatttccgcattggaagactgcatagaccgttacacggctgaagcgcccccgcttgagaaatttattcttccgggcgggcataaggcggctgctcagcttcatatcgcgcggaccgtcacaagacgggctgagcgtctcgtcgtgaaactgggcaaaacagaagagataaacgatacggtgatgcgttacttgaaccgcctgtctgattattttttcgcggcggcaagagcagttaacgcaagacagggcgttcaggatatagagtatgaaagaagcgccgcggtattccgtgatgatgaataacgttttgttcagccggcagcagcaagccggctgtttttttatagagatatccatcaattgaacctttattgacagaaggaaaatgtatcttatgcattattgactgaaaaattaaaaaatgagatattataagaaacattgtaaaataatgggggatttgatagatggatacatataataagagcgagagcatctggaataaaaatttcacccttctgtttatctcgaggcttgttaaattgtcaggcgacggttttgcctttaattccattctgtggtttttgatttttgacggggaaggcgcgatcggcacgtccctgctcattgcggtcacgttccttccggaggcgatgctggcgccgattaccgggccttttatgaagcagcatacgctgaaattctggatgtatttctccgatctcacgcgcgcggcggtcgtgttgatcattccggtctgttactttaacggtttttctcctttatggtttgtcatgcttctcatgattttgcattcagccacgggagccgcttataatcctgcatctatctcattaatccccaatattgtcggagaaaacagcctgcagaaagcgaatgcggtcatccagtcatcaggccagatcgtcagacttgccgccattacgctgagcggggtgttcttaacatttatcagtcccgcttattctttgtttatcgctcttatattctatcttctatcaggttttctcgtactctttatgtcataccaagtccagcatgccaaagaggataccgtcgccgtcagacagcgcgggacgtatgtcggaaggctcaaacggggtttcgttcttgtcaggaaacaccagattttatacccgctcgccatctattgtatcttcatgaattttgcggccgctccgtgggaggcgctctctgccgtttatgtcgccgaagatttaaacatgccgccgatcatctactcgcttttgaaagcgacaggcacgggcggagcctttttaatgggttttattttggctaaggtgaaggtgaacaaatacggtctcctgtttgtgtcagcgggaatcatagaaggggcggcatttttcatcaccggcctcaacacttttctgccgctcgtcttcctcgccgcgtttgcgttcggatctgccgtcagcgcgattaatgtgccggaatatacgattattcagacgtctgtggaccatgatgatcagccgcaagtctatgccgtcatccatatgatctcaaacatatccattccgctcggcgcggttctttgcggatacgcggctaacgccttcggtcccggaaaagtcattgccgccggcggtctcgttgaagtcctgtccggtctcggaatattgctctttacgaagctggccaaagctgaacgctcagatctcatcagggaaaaagaagcgagcatcagaatatagatttttcgtgaaacgccctgcgccgtccggtgcagcggcgtttttttatgcgaaggtccgggggttatacgactccggtctgatatgaaaatcaatctctgactcgttttgccggccgcgggatttgtttatagtaaagacaaggaaaacgaaaggaggatctgcatgaatataaatgtaaaaacggcaggcggctttctgctgattgtgttcggactttctgtctttttcggaggaggccatttcgcatttatcatcccgctggcgatcggaggcctgatgctttactggggaatcaaacgtttttcaaaaggccgggcggtatcgggtatcatcgcgggcttcatcggagctatgattctcgtcggttctcttccatttatcgttgccatcggactggctggcgccatggtgtatttcgggtggaagatgatgaagcagggcggctcagacaccgcttcccgccagtatgaaccggaagcggcatcaccgggctatcaatccggatttgactctgaatgggaagaatttctgaagaaaaaataaggaggaagacaaaatggtcttaaaaagaataagaaatatgttcgtcgcatctgttaacgaagggcttgataaattagaaaatccgaaagtcatgctgaatcaatatgtgcgtgatatggaaagtgacattgctaaggcgaaacaaacgattgtcaaacagcacacgatcgtccatcagtttaagaaaaaacaggaagacgcttccgaaacggcggcaaaacggaaaaaccaggctcagcttgcttttgacgccggggaagaggagcttgcgaaaaaggcgctgactgaaatgaaataccttgagggaaaagcggccgaacatgaaaaagcgtatgagcaggcgaaaacacagctggcagagctgaaagagcagctggaaactttagaaacgcgcctccgcgacgtaaaggataaaaaacaggcgctcatcgcccgcgccaacgcggcaaaagcgaaggaacatatgaacgcttctttcgacaaaattgacagtgaaagcgcctacagagagtttcttcgaatggaaagccgcattgaagaaatggaagtccgcgtcaaatacggcacttcagctgaggcgaacacagaatacagccgctcccaatattcagacgaggtggaagctgagattgaaaaaatgcgctcgctttctctggagaaaacagagcatcaaaaagcggctcatgaataatgtgcacaagggaagatcggcgcttttacgcctcttccctatacgcacgtatcaattctccggcttttcctttataataaaatgaatgaaaaaggatggaacgtaatgaagcgtaagatggccaaaggactgatggcggcgtccgttctgatctgctgtctgtttttggtgaaagaagtgtttgccgggcgtttttttccgctgtacgaaacagaagcggaatcggcaagcataccgccgcgtgccgtcaacagcctgtcggtttcatcggaacagacggatgtaaaaatcatcgcggaagcgcggaatgatatcgcggcaaacatggcgggaccggcggggaaaatgtttgtccaaagcaggggaaaaaccctcaatctcaaagcgaaggagaaagggttccaatttctgaatctctttcagcgtcctctgctgattgtccgcattccgtatgattatcatcgggacattaccgtccatacgtcaagcggcaccattgccgttgacggaaacaaggggctgtctcttgcgcacctcggcgtccgttctgtaagcgggaatatgtcgctgaagcacgtgaagacggatgtgtttgaagcgaaagggctgtcgggcaacctcacagcatcaggccttgcggcgaaaacgggggatatccgcttatcctccggacatgtcgggcttcaacatgcggcgggcgcccttgacgtgcgggtcgcttccggcagtgtcgacgcctcgcttgagatggcggatgctcccgtatccgtcaggcttgcgagcggcagcgcagcgatcagcctgccgaaagacggaagttttacggtgaacgccgagacggcaagcggaaggattcagccgtcttattcctttgagaaaacgagtaaggacggcggggcattcaccggtatgaagggcagcggcgccaggccgattgatataaaagtgacgagcggcaatattgcactgcaatagtcaaggaaaggaggggcaggcagctgatggcaaaaaaacagattctcggacttatcatcgccttattaggcgtcagcatgtttttgcgtattatcggcatcggcgacttcttgttttggccgctcttttttctgatcacaggctatatttttaataaatattcccgcggctggctcggctccgtcctgtatatcttcgccgcttttttatttttgaggaacctgttcagcgccacctttaacctgttcggctatgccttcgccgcctttctcatatacgcgggctacaggctcctgaaaggaaagcgcgtgtatgaacataaagagaagaaaatcaatcttgaaaaagaagagcagccaaagccttccgcccagacggaaagcagacagccggacctccgcagcttttttatcggcgagctccggatgatgaaggacccgtttgagctgaatgatttaaatgtttccggattcatcggcgatgtgaaaattgatttgtcaaaagcgatgattcccgaaggagaaagcacgatgaccatcagcggtgtcatcggcaatgtcgatgtgtacgtcccgccggatatcgaagtgtccgtcagttcatcggcttttatcggcgatatgaacctgctcggctctaagaaaagcggcatgagcccgaatctttataaagtatcgtctgagtacggcgactcgccgcggcggattaaaatttcaatttctttattcatcggcgatgtggatgtgaagtatttatgaggaaaaaattactcgccaatattcagtggcgcgccatgcggatgactgcggggctcagtctgctcctttgtgcggtgtttattacgctgatgctgctgtattacgggcttgacccgatgctgctgttttcttccggctggttcggtattccgtttgtggtcatcctgcttctggcgtctctttcggccggattgatttccggttatgtatacggcggccgcctgaaaacaagaatggatacactgattgaagcggttttgaaatttgaaaacggcaatttcgcttatcgggtgccgccgctcggcgatgatgaaatcggcctggcggcagatcagcttaacgaaatggccaagcgggtcgagctccaggtcacatcgctgcaaaaactctccaacgagcgggcggaatggcaggatcaaatgaaaaaatcggtcatcactgaagaacgccagcggctggcgcgcgatctgcacgatgccgtcagccagcagctctttgccatttctatgatgacatccgccgtcttagagcaggtgaaagatgcggatgacaaaatcgtcaaacggattcgcatggttgaacatatggcgggggaagcgcaaaacgagatgagagcgctgctattgcatctgcggcccgtcactttagaaggaaaaggcttaaaagaagggctgattgagctgttaaaagagttcaaagcgaagcagccgctggatattgagtgggacatcagcgatacgggtgtgtcaaaaggtgttgaagaccatctgttccgcatcgtgcaggaggcgctttccaacgttttcagacattcaaaggcgaccaaggtcaccgtcaggctcggcgcgaaacatcaaaagctgcagcttaaagtcattgataacggggagggttttacgatggatcaagtgaaagcatcctcatacggcctgcattccatcaaggaaagagcgagtgaaatcggcggcatagcggaaattatctccgtgaagggaaaaggcacgcagatcgacgtgaaagtcccgatttatcagaaaacaaaaggagagaacgacagtgattcgagtgttactgattgatgatcatgagatggtcaggatgggtctggccgcatttttagaagcacagccggacattgaagtcgccggtgaagcatcagacgggcagcagggcgtcgatctggccgcagagcttttgccggatgtgattttaatggaccttgtcatggacggcatggacggcatcgaagcgacaaaacagatctgcgcgaaactcaatgacccgaaaatcatcgtgctgacgagctttattgatgacgacaaagtgtatccggtgatcgaagcgggagcgctcagctatttgctgaaaacgtccaaggcggcagaaatagcagaagccatcagagcggctgccaagggtgaaccgaagcttgagtcgaaagtggcgggaaaagtgctgtcaaggctgcgccattcagagaatcagcttccgcatgaaacgctgacgaaaagagaactggaaatcctctgtctcgtcgcggaaggcaagacgaataaagagattggtgaagagttgttcattacgattaaaacggtgaaaacccacattacgaatatattgtcaaagcttgatgtcagtgaccgcacgcaggcagccgtatatgcccaccgcaatcatctcgtgacataaaaaaaggagagcggcgccggcacactctcccgagggacggggtcattgggacattccctttgttccgaaatccctgatggcgactttgactttgtattcaatatccgattcactgaagtgatgatcccagtcagaggatatctttttccatttatcaggataatgaatccggacttgatcgcctaacccggtaatatccactttcaactcatgctgcatgtaatcaatgaatgccataacatctgaatgaatgctgcgttttaccgcgtttttgatttcatttatataggactccttgaaagaatcttctttcggattccaatcctcagacagacggccttcaacaaaccgggtgacgataaacttgaattttccgtttttatattgtgtttttacattatatttgctggaaaatacctcgaaagataaataataattgtcatgctttgcaaacgtgacgcctccctttaccgtgcctgtgaacaggttcatattctggacttgtaaaggcgttaaatttgcataccagaatttatttttaataatggtagcgccccagatttccagtctgctgcccactttgcgcacttgaggaagggcaaaggtttcgcccttggcgattttctctgatatttcccccaatgtcacgggctccatcatccggatggtgaccgaattattctccgttaagtcatagatcgtatttgacgcaggttctccctggtcactgatattgaaaatatctttcgttttatccggcaccgtcatcacattgcagcttcttctcgtaccgttgtctctgataaattggttcatcaatgcgtcaagcggaatgtcatcctttaacagcgcttcggaaaacagcatgatacgcaagtgctgggagaaggcggggtgattttttaacgatgccgttcttaatgcttgatggacggtttcccctggagtggaagtcacctttgtcgtgtcacctgacgacgactgctgggcacttgctttttgcggaaccagaatctgctgtgtcacttccacattttcttccgcgggtttatctagcccgactccgataacgaggctcaagtcttctaaattgcggctgtcccagcacccggccaaaagcaatgtgcaaaatatgattacgatgtatttcttcattgtgcttttttcaccttccttttcacagcgacgactgcaaacatcagtaaaggcagcaaaaagaaaaccaagaagatatagccgagaatatcactgaacagcatcagcttgtttccgtcttttggcaacaatgatccgaagaatgtcgcgatgcctacgaagatgatgccttttttctgtttcagcccgaaaattttatgaagagctgatgtcgcgaaatatccgtatgatacataggtggcgaaaaactggatgatccagacaacaagcaaaaaggactcgaacctttcaataaaaagccctttgatttcaaatgattgaaagagcgcgatcgttggccagatcattgttttgacatcctgggtggttaaggcgccgacgacgagaacgtaggtaatgatgtataaaataatcgggatgccaaagcctatggccgacatgcggaatgtgtgctttttatttttgaggtactcggggagaaacagcataatctcaattcccaagaaggaaacagaaacgacggtcaaggaagccataacgggagaaaatccctgcccgagcaccggccgcaggttgtccagatcaaatattttaaagctgaaagaaaacaccaccagcaaaataatgatcgtaatcgttaaatagaaaggaaagagcctgccgatatcgctcatgccgccgataattaaataaacggaacaggcgataaagataaacagtgtgaccggcacgggcgttctttccaataaaaagaacttgaccatttccgccatcgcccgggcttcgaagctggcgactcctataaaatagagacagatcatcagattgacgatatttcccgcccatttgccgagtccttcattcatataatcaaataatgatccgtactgatgctttttcataatgagcgtattgagataaatcaaaaagataaagatgacgccttccagacataacgcgatccagccgtccggcgaatttgccctggatgacagcgcccgcggcatggtgaggagccccgcgccgagcatcgtgtttgcaatcaatgctgtcccttgatagcttgtaagcttattgtgagttgttttctggctcatttacgtttttcgcctcttttggttgatttttaatagggagacggagaatagagtcgtttgcgttttttaagctgaaaaatccattcggcgagaaatacggagaaccgaagcttcgctgtctcgataaatgagtgtagatcgccagcataaataaaatcatgccgtacagcccgaaagctgccgcggtaaacatcgaaataaaacggagcacacggaacgacagacccatcccgtactgcggcaccgtaaatgaagcgagcgcgacaatgctgaccacgatgaccatgatggagctgacaatattcgcttcaacggccgcctggccgatgacgactccgcccaccaatccgatcgtctggccgagcgggctgggaagcctcaagcccgcttccctcagcagctcgattgtaatttccattaccatcgcttcaatgataggcgggaaggggacgttttctctgttcgccgcgatggtgactgcaagcgacgtcggcagcagcccttggtgaaacgaaacgagggcgatataaatggacgaaaaaaacagcgtgataaaaatagacgtaaacctgagcgcccggatgagcgaggcggaaatccaccgttcataataatcatcgggagactgcattaaaattcctaaagaagccggaaccaccagcgcaaacggcgagttgtcgacaaggatggcgacgcggccgttgaacaaggcggaagagactttatcaggccgttccgtattttgtatttgcggaaagggcgaatacttattatcctcaataagctcctcaagcgttccggaatcctggatgtcatccatcttcactttgctgaggcgctttacaacatcgctgacgacagacgggtccgccttatcatctatgtacatgaccgtggcgtattttaacttattttctccgatcggaacctttttcgttttcagcttcggatggttcgtgcgctgcctgatcatggcgatgtttgtatcagaatcttctatgaaggcgattttcggacctcttacgaccttttcggatgtgggttcatttacgcttcttttttctctttttcccgtggacaaaatgtatacgctgtcaagtccgttaataaacacggcgcattttccccgcagaatggagatgacggcttccttcgacgtaaagacgggacgggcgttgatcttatcaagacgtttcgccaccgtatccagcgtcagagtgtcttcctcctgaagcagcgtttcaatcgcctcttttattttgtcttcgtcgttcatttcactcagatacatataataaaaaacaagcccgttcggaagcatctttttattttgaaccaggtcatcattctgctctacgtggggaagcaccagtgccagattaacgtgtatgtattccttgaactccgattgcgtcatcgacagtcacccgccttccaatccttaattgaggttatcttttcctgttaaaaaaatgatatactatgataaagtatttaatggtacaagtttttttatgaaagcggaggagagatgtggcacaagtcagactggcaggaaatgccgaagaaattgaacagctcatcaaatcatttgaagcgcattacgaagtggcttacacgtcgaaagaataccgtaaaacaaatccgaagtataaatactctaaggattcgcgcgtctatcttgagctgaaattaaaaacggccaaggccgaaaaataaaaagggtttcatctgttactggcgaataatactcagggtgaagcaactgttatggagggatacataaatggactacagaattgaaaaagacaccatgggagaagttaaagttccggcagataaattttggggcgctcagacacagcgcagcaaagagaacttcaaaatcggttcagaaaaaatgcctcagcgtgttgtgaaggcgtttgcaatattgaaaagaagcacagcgatcgccaacgaacgcctcggcaacttagagtctgaaaaagcccaggcgattgccgctgtatgtgacgatgttttaaacggcaaatacgacgataactttccgctcgttgtctggcagacgggaagcggcacgcaaagcaacatgaacatgaatgaagtggtggccaaccgcgcgactgctttattgaaagaaaaaaattccgagctgaagattcatccgaatgatgacgttaaccgcagccaaagctcaaacgatacattcccgacggcgatgcacgttgcggcggttcttgccgtatatgagcagctcgttccggcgcttgatcagctgcgcgcgacgcttgatgaaaaagcgaaagcttatcaggatattgtgaaaatcggacgcacgcatttgcaggacgccactccgctgacgctcggacaggaaatcagcggctgggtatacatgcttgaccgttcgaaagaaatgattcttgagtcaacggaaaaaatccgcgcgcttgccatcggaggcacggcagtcggcacgggaatcaacgcccatccgcagttcggtgaattcgtcgcggaagaaatcacaaaagtaacggggcagacattcaagagttcgcctaacaaattccatgcgctcacaagccatgatgaaatcacttacgttcacggcgcgttaaaagcattggctgccgacctgatgaagattgccaacgatgtcagatggctggccagcggcccgcgctgcggaatcggcgaaatcgtcattcctgaaaatgagccgggaagctctatcatgccgggcaaagtcaacccgacgcaaagtgaggcgctgacaatgatcgccgcgcaagtgatgggaaatgacgcgacaatcgggtttgcggccagccaaggaaacttcgagctgaatgtcttcaaaccggttattatttataacttcctgcagaccgtgcagctgctcagtgacggaatgaattccttccatgacaaatgcgctgtcggtattgagccgaaccaagagacgattcaggaaaatctctctaactcattaatgcttgttacggcgcttaacccgcacatcggttatgaaaacgccgcgaaaatcgccaagcttgcccacaaagaaggcctgacactgaaagaagcggcattacagctgaaccttctgacagaagaacaatttaatgaaatggtgcgtccggaagatatggtgcacccgaaagcataaaagaaagaacggctgcagtcattgcggccgttcttctaaataaactgctgtttcagtaaaaatctgagctgttctgcatcttcagccagcaggtcggattccttcaaattcaaaatcattcctttgatgattgccggtttcggcgactttttcttcatttccgcttccagaatatccaagctctcggtgaattcagatgcttccgccttgtccatcgtgccgatgcgcgtgcggagggtctgcaagatcgattggcttaaaggatcgggctgcccgttatgaaggggcccaaacagtgagcttgcctcatcaagagaaataaatgcttcatcatgtctgcccgccattccgtttacgatgtcatcaattctgtgaatcacggtatttgccaaaagcgaaggctgtacggaccggccggtcagaatgagatattcaagatacatctgactgattccttctattaaaaaacaaagctcggctgtgtatggttcagctttttctccgtaaacagcaagaagactgtcgatatgaaactgcaggatcgaccggcggattctctttccgcactgcgccgcttcttcggtataaggaagtgaaccgtctttcatctgcatggtaataaaatcctgatgggcgagaatcgattcgtaaaacaccgcaagctgtttttgataagcggctctcggactgtcaccctccgtttggatcgtcgtgattcgggtaaacgttttatcatagtagtaattcagcatggataggagcagtgcttctttggaaggaaagtaaagataaaaagcgccttttgagattttgcattcatcggcgatttcctgaaccgatgtagatttgtacccttttcgggcaaacagtttgattgctgcttcaatgatcagcttttctttttccttcaatggttccaccctttcggagccaggaggctggcttgtgcttctcatgtatgactatatggtcatattgatattccgtaaatttaacctgattgtaacttgtttttttgttttgttttatttatattataaagtgagctgaccgaatggtcaaagttctggcgaaagggtgaatctgaaaatgaaagaattagatgaaatgatcagccgcttgcgaaacagaggaattaaagtcgaaaaggtgaaatatccgaaaaagacaatttgtgaaaagaaatgggttcatcaatgccaaaaaccgctgaaagcaaactacagagattttaacggctattccttcacataaaaaaagactgcaatgaaacactacagtctactttggtatgataattcggtagattacacccgattggtcattttcaattgaaattgatgctttatgcagggttaaaatccgttttacgatgctgagtcctatgccgaactcgcctttcttccctttattaaaaggctcgtacaagctggatagcatctcatcctcaatcggaggcccgtcatttttaaccgtcatgacaatctgctgctgattttggctgatccgaatgtgaatcgccgtttctgcatagcggatttgattttcaagaatgttttcaagaagtttgctccattgttccggatcaccgggcatcattaatgcatcttctgtatcaacgctccacaataattccttccgggcccatttgagccgttcaatgacttcttccgtgaccttcacaatgtcaaatgtctcatggtgcacccgctgcttcattaaataatcaagcttcgttaaatataataaatccttaattttcttctcaagtttttctgcttcgccttcaatgacatcaattgtggtttccagatcccccttaggaaaaatcccgtcctttattgattgagtatagccccttatcaccatgacaggcgtttttaaatcatgagagatattttgcaggagcgttctttccgtttcatccttttgcaccagcttgctccgcatgtcttcaatggtatggcctaattttccgatttcgtcttttctgtcgacgatgaccggatcatcccagtcctgttcggaaatccgtttgacatgcttctctaaggaaacgagcgggcgtgagagatatttggcaagccaaatcgccggaatccagcttaacaaaatcacgccggcaatgataaaaagcagctgcttgaacagggtgaatgccagatcatcacgataagaatcaagggcgtaagacagcatcatcgcatcctggccgttaatggtgaggccttttttaatgacgaaaaaaactttttcaccgctgatgtccgcgctgtatcgtttcgtgacgctgtgctggcggcccgcgagcttgtacaccttatggataaaggaagaagaaaaatagttcaagtctttgtcactggccgattcctcccgctccggcagaagaacgtgctgaacggatcggaaagtcgtcggagcggtcgcatcctcgctgtaatatccccgctcgatcgatccgggcagccggtactccgtcagtacatgctgttcattttcaatggtcgtatacgtttcatccgtgaaaaaattacgcagcgtatttgagaacagcacgagaagcagaatcgagatggctaagaggatgcctgagatgaccacccatatttgaaaagcaagcggcttatttttcatgacgtcatcatcctgtagccgaatccgtaaatggtctcaacctttaacccgggcattttttttctcagcctccgcacaaggtcatcgaccacccggtcagtgccgaaataatcatggccccatattttcagcaggatatcttctctggaaaaggggtgtcctttatggtgaagaaataaaagcagcagatcaaattccttagacgtcaaattgaccaggctgccggtttcatcataaacctcccgggcatcttcgatcacattgtaggaagaaacggtgatgccggttttctttgcggcgggctgttctttatacacgagctcgagcagtttctggacccgtataataagctctctcggcaaaaaaggcttggcgatataatcattgcttccaagctctaacccgaggactctgtcaatatcggcatcccgcgcggaaatgaaaatgaccggcacatcgggatctttttcttttatttcttttatcaatgtatagccgtccgtatccggaagcatgatgtcaagaatccacaagtggggagacggctgcatctgctttctggcatcttcgccttttgtgaaagatgtaatgttccagccttcattctctaaatattttgtgagcagttcattcaggttatcctcatcttcaactagataaatggtgtatgacaaggcatttcacatcctttcaacgtcattatactagttttaacatactcaagccgcattttcataatttcacatattcttttcatttttatcccacaatgtttgtttatgatgtgtataagggaagaaaggaagaaaaaaagcggggaagataacatgttcaaacacattttgttttggagctttgcttttctccttattattgggacaatagaacttgtacatgcgatgaatatgtaatcgatagaatgaaaacatgctgaaggagtgtgcgtgaatatgaacgatcatcgagatgacggcagaagccgcgatcagtcagatctttcacatacggaacaaaacagaaatgaacagcagcagatcagccatcaggagcccgagctgcttgaagggaccgtctcgaaagaaccggaaaacgagacggctgccggtacggaatttgaaaaaacggctgccgtgaaaaaagaaaaaaaacggagagccgcttggctgagcccgattttaggcggcattatcggcggaggcctcgtgcttggcattgtgccgaacctgccgggtgagcagcataagacagaagccgtttctgatacgaaacaagttcagtcttcgaattttacgtcaacgcctttgaaaaatacctcaagcgtagcggatatggtggaagaattggagcccgcgattgtcggagtgtccaactaccaagcttcgcaaagcagccagttcggacttgacggcggttcaagctctgaaacggaaagcggcacggggtcaggcgtcatcttcaaaaaagacggcgaaaaagcgtacatcattacaaacaatcatgtcgtagaaggggcgaacaaactgtcggtcactctttacaatgggaaaaccgaaacggcaaagcttgtcggaaaggatgccatcagtgacttggctgtattggaaatcagctcgtccaatgtcaaaaaagcggccagcttcggggattcctccaagctccgcattgccgataaagtgattgccatcggcaacccgctcggccagcagttttccggcaccgtcacacaaggtgtcatcagcgggctgaacagaacggtggacgccgatacatcccaaggcacggtggaaatgaacgtgattcagacggatgcggcgattaaccccggaaacagcggcggcccgttaatcaactcaagcggccaggtcatcgggatcaacagcatgaaagtcagtgaaaacggcgtggagtcgctcggctttgccattccgagcaatgatgtagaaccgatagtcgaccagctgcttgcaaaaggaaaagtcgagcgcccgtttttaggtgtgcagatgattgacatggcgcaagttccggaaacctatcaggaaaacacgctcggactgttcggcgaccagctgtctaagggtgtttacgtaaaagaagtgcaatccggctcaccggctgcgaaagcgggcatcaaatcaaatgacgtcattgtacaactgaacggcaaagatgtcgacagcagcgccgatatcagacagatcttatataaccagctgaaaatcggcgataaaacgactgttcaagtgctcagaagcggaagcaaaaagacgctgaacgtcacattaacgaaacaaactgaaagcgcaagctgagcgcataaaaaaagctgaaccttcaactgaggttcagcttttttcgtcattctcccaagtaggctgacagcatccacacatgcttgtccgcttcttcaactaatccgacaaacaggtcggcagttgacgggtcattttgttcctctgcgatgccgatgacaaattttgattcgcggctgatttgtttatagtcttgaaccagtgatttcaccatttcagaagccgttttttcctgaccttcatccgtaatggaagcttgttcaaggtaagtgtgcaaagtcgccgcaggctgtccgccgatggccagaagacgctctgcgatggcgtccgccgtttccgctgcttcgttatacagttcttcaaatttttcatgaagcgtaaagaagtgagggccttttacataccaatggaagcggtgcagtttagagtaaaggataaaccagtttgataattgtgtgttcattgatttctcaacaagagtttcagtttttttcgcgttttgtgtattcatattcatcgtcctccctgtgatctgttaatttaattatatcacgtatcaaataaaaatcaatactaaattataattattataatttagtttaagtgaacagctttttctttataatcgattcccaagcggaccacggaaagagtgagcggaaagccaatgtcagcttaacgcccctgccgatcggataccgcagtttcttcagccgtttcctttgtgccaattgataaatcagctccgctacgtcatcaggatcgccgcttttggatgcgttggctttgaagtaagcttcaaggggctgataaaagcgataataaggcgagtctttgccgggcgccgtaatatggctggagagagacgtctcccaaatagacgttttataggagcccggttctattaaagcggcatcaattcctaaaggcagaagctcgaggcgcagacactctgtaaacccttcaaccgcgaacttggaagagacatacggagatagagccgggaaaccggtcagtccgctgatactgctgatattgaagattttcgccccgccatgtttccgcatataaggcagcacggtttttgtgacgtgaatcagaccgaatacatttgtttcatactgctgtctgtaatgttccatcagcacatcttcaataaaccctccgtacgcagtgccggcgttattgacaagcagctcaatcggtccgaaaccgctgatggtgttcccgaagtcagacaccgactgctcatttgtcacatctaaagaaacgaccgtaatatatgcggatgcacccgcttgagcggcggcctctttcagtattacagctttctccggctgtctggctgttgcgatgacgtgataagaccgggcgagcttcagcgctgtcagcatcccgaatccgctcgtcgcaccggttacaatggcaacttttctgttcatcttataatcctccccgtttgtcgtttgttcttatctcatagtgtataacatctcgcggaaagaaggagaaatcgttcggaaatatgtcagaattgttttataatggagtcagcttcggatagaaaggggtaaagaaaagatggcattagagggattgaaggaaacatgggatttaaactccatttttgagggcgggagccggtcggaagagtttcagcaatacatacaagagctcaaaaagcatctaagcgcttttcaacatgcggttgaagcatttacagttccgacgcacgcggatgaaagccgggagctgatcaatctgattgataggtttgaacggtcagcgatcatgatcaggcaggcgggagcgttcgtcggctgtcttcaggctcagaacactcatgatcagaaagcgaatgaatggagagcgcggatcaatcagctgagcagtgattttaaatccgctctggtcacccttgacgatacacttgcccggattgacgagcgggtctgggaggagctcctgcaaaaaccggaacttcaggatctcacatatgttttaaatgagagaagagaccgggtcagagagaagctcagcgcttcagaagaaaggctgattgaaggcctggccgttgacggctatcacgcatggggcgacctgtataatgcggctgtcggcagaatgaagattccgtttgaggataaagagctgtcggtcggccaagcggaaaatatgatggcgcacccggatcgccgcatcagacgtcaagtgttcaaagagcttaatgaagcctggaaaggagaagaggagcttttcagcagcacgctgaaccatctggccggcttccgcacggaaatctataaagcgcggggctggaaaagcgctttggaagagccgcttgcgatcaatcggatgaaaaaagaaacgctggatgtcatgtggcaggtcattaccgatcataaaaagccttttgccgaatacctgaatcgaaaggcgtctcttttagggcttgagcggctgaactggtatgatgtgggcgcgccgatcggcgaggcttcgaaagaatacacatatgatgaagcggctaatctgatcgtcagccaattttcgacgtttggcaaaaagctgtccgcattcacggaaaaagcgttccgcgatcggtggatagaagcggaagaccgcagcggcaaacgggtcggcggtttctgcaccagctttcccgacagcggagaatcccggatttttatgacgttttccggaagcgcttcgaacgtatcgacgctggcgcatgagctcggtcacgcgtttcatcaggaggccatgctccaagtgcggcagctgaacagagcctacgctatgaatgtggctgaaacagcctcgacctttgcggaaatgatcgtcgccgacgccgctttgaaacaagcggagacaaaggatgaaaaggtgttcttgcttgaagataaaattcaaagaagcgtagccatgtttatgaatattcatgcgagatttttatttgaaacgcgtttttatgaagagcgcaagcagggcgtcgttccggctgagaaactgaatgaactgatggaagcggcgcagaaagaagcattttgcgattcattaggggaataccaccctcatttctgggcgtcaaaactgcattttcatattacgggagtgccgttctacaatttcccgtacacgttcggttatttattttcgcttggaatatatgcaagagctcttcgggaaaaagcggattttgaagaaaaatatatcgcgcttttgtgtgacacggcttcgatgaccgttgaggatttggcgatgaagcaccttggagcggatctcacggaacggtcgttttgggaagacgcggtccgccttgccgtacaggatgtgcaggaatttttagagctgactgaatgataatctggagatgaaccggccggagctgttaccgctccggttcttttttgttccgtgaatgacagccgcctcccttggaaatacctaaaaacgatcggaatggaatgggagtgaatcgcatgaaatggatcagaacggcgggcgttttatgtcttacgctgatgctgattgccggctgccgattgaatgaagaaaaacgggaagcggaacaagacagcacacctgtgtcatccgagaagccggttccttacagcagcttttccctgcgcgtcagctacggagccggagagcataaccgctatgaaggtttgtatgaaagaaaaagcggtcatgaaaaggcggacatccgggacaagctctcaggggttcacagagagggcgaggaagcgcttgatgaaatgaagatgatcctcggagaacttgccgtaaacggccggatgcaggaaagcgaggtcgtccgggaggtgctttcggcttttaatttggacagccgctatgaccatttttatctaaaactgaaaaagaacgatggagtaatgacggaaataaaaaaataaccgccgcccgctgcttttttacccaaaactaattgataatgatattcagagtcattaatttctgttacaatataatcatgatctcacgttgaatgtttaggcaatttgtttatatacatagtgttgggaaactcaaaaaaggagcggttagcggtatgagtgcaatttctacagagacgctgagcttagggtacggagagactgttatcattgacgaattggatgtcgcgattccaaaaggcgaaatcactgtattgatcggaagcaacggctgcggaaaatcgacgcttttacgttcattggcccggctgatgaaaccgaggggcggttctgtgcttttagaaggaaaagccatcgctaagcttccgacgaaggaagtggcaagagagctcgctattttgccgcagagtccgtcagctcccgaaggcctgacggtgcatcagcttgtgaagcagggaagatacccttatcaaagctggctgaagcaatggtccaaagaggacgaagacgcagtcacaaaagcgctaaaagcgacgaagcttgaggaaatggccgaccgtcctgtggattccttgtcaggcggacagcgccagcgtgcatggattgcgatgacactcgctcaggatacggatatcattctgcttgacgagccgacgacttatctcgacatgacgcatcaaattgaaattcttgatttgctgtttgaattaaatgaaaaagaaaaacgcacaatcgtcatggtgctgcacgatctcaatctggcatgccgttatgcccattatctggtcgccataaaggataaacagatttacgcagagggccgtcccgaagaagtcatcacttgcgagcttgtacagcaggtctttgcaatgaactgtcaggtaacgcaagatccgctgttcggcacgccgctttgcattccgcacggacgcggcagatgtatcgtgcaggaagcggccctcaccgcccgattgtcataatcatgaaaaagggaaggaaacggtatggaagaaaaactgcagcagcagctggacggcctgcttgagaaatacactgaactattgcttggcgaaacaaacccggatgtaaaggaagaagtcaggcagtggattttgtatacacatatcgcaaaaagcatgccgccgctcgtcaaacattggaatcaatcctacccggacgccaaagagggcatcaaagctgcgatacagcacattaaacagctcaatgaagctcacagaaaaaaacaataaaaagctttcggcatcaaagagaggtgccggaagctttttttgctgaaaaggaatcaataaaggcgccgttcaattcataacgaagaactttaatgtaactaacacacccgtttgtttacttgctgaaccaagaaaaaaggaccgccgcagcaatcccttactctttcctatatatcacatttcctttcggatacgtaataactcttcaaatgcttttatatttgtatcaaaattgggcactgtttgagattcctcggcacatttgacttgtgctacaaccaaatcattaaaaggtgttgaaattccagtaccttctgccattttgggaataactccattaatataatcaatttcagttttgcgttttttctcaagatcctgaagcatacttgctcttaaaagcctggatggttccatggctgccctaaatgtttgaatacgttcaggaatctcattttcactttttaattccaaagattctaaatcaaggccgcccattttcgcaaatgtgacaccattggcgtgtccaaccttaatcgtctcatctgcgatatgaactgcgctgacaatgccgatttcatggtcaagaatatcaccgtattctccgtttaatgctgccgataaaccactgaatgcattattgataagtaattttgaccacttcgttccaactaaattatcggaaatatgtgttccgccgataaggtctaaaaccgatttaatacgctggattctttctgttgtttcaccatttaattctccaatttgaaaagcgtactctttaaattgagtatactcagttgtaagtctggatacgcctggttcaataaacgtagcaccaaattcaacagaacctgcaataacacgttcaccaccaacgatcgaagcaactttctgttcaggtataccgttttgcaaggaacatactacactatcatcctttaaaaaaggcagtaactctttaagaatggagtcattatataattgtttcgtcaggagcaatatgaaatcatacttgcctgacttgttttcaggggtaatggcttttacctttgcctgaaatgccgttgtaccaactactttagcacctatttgatttaaagtatctacatgttctttgtatgaatcaattaattcgacatccattccgccagcagacagatatgctccaactatggttcctaaagaacctgctcctaaaattgcaattctcattgtaaacgtctccttatttttcctctaagtagttataaaccggctgtgctgcatttaaggttaaatccgtaataatatgagatgctgaaacgacttctaatacaggcaaatctgcaagaggcgccagagcatgttcaaataattgaagccgcgccggtccagaccaggcacctttaacttctatattcgttatttgcgtgcgcaccaaatcgcaaacccttaaatcaccattgtaatcagtagcaatcttaaccataaaattaggtcggcaaatttcccttttcgctttttccttgtccatttcgaaatgtttatatcccatagtcgcagctgccacacgaagactgccataatctaatgtgccaacgagagtatcagagtctatatacagcttaggggcgcccaatttctttggatatgcagtaagttcccgtccgcttgcaatagccgggaaattgtctacatacatagagtgtacataatctccttcttcaccattaaagctgacagggatgacttgtcctgcctctgtataggcaccaagtccggaaacatcgggcatccgcatcacttcgaatttcactaaaggttcagtaatttcaagaggttccggcactgccgcacgcaaagctttttcatccgttcggtaaataatatttaaatattcacggttaacaaatttataatttgggataggataagcaggagccgttagcggtgtatttaaattttttgctatatctttcacatcaattttcattgcatgacaccctttccttttctttaactatgctattatcttacatccgcatttacatttaatctaatacataataaggtatatatatatttattgaaataaataagggggatgcagacagatggaattgctgcagctaaaatactttcagacagttgcctatactgagcatatttctaaagcagcagaacaattaaagattgcccagccttctttaagtctcactataaaaagacttgagaatgaactgggaacagctttgtttgagagaaaaggcagaaatattaagctgagttcatcagggaaaattcttttaaaacatgtaaacaggatttttactgagattgaaaatgcacaaacggaaattcaattggaggaacatcaaatgtctgacaccatcagaatatctatttctaatccgagattccttgcaggactgatgagtgaatatatcaaccgctcccctcaatcaaaaattctccaagccatcggagttaaaagcgggatcctaacaagtttaaaaaaaggggacattgatttaggaataacaggtcatcctattcaagatgaagagatagaaagttgtatgctggtaaatgaagatattgttctggctttgccctcaaaccaccgatttacgggtaaaaccgaaatttctttacgtcttgtcgccgatgaaccatttattacccttgctaataatgaagagtatagcggttttacagcctcgctttgtgaaaaagccggtttcaccccaaatattgcatttgaggcggattctcatttactggccgagattataaagctggatcagggggtggcgttgcttcctatttcggtttgcagaacattggggctgaattttataaaagtgactgatcactctgcttcatatccagtcggcttatcttggatgaaacataagctgttatcttcttcggtaagaaattttcgtgactttattttgtcgtactataaagataactatgaaatgtttaaggtttattaaataattttcacccccgatttccaatgaggcggaagactggtcattcggaaacggagaggcccagatgatataaaaaaatcccgcggcatccgcgggatttttctttgttaaacggctttcgccttttcttcttgtttgcctgtctttttgtttgtcagcttaattgatttaacaaacagcgtgaggatcaatccggcagcgataaaggccaggcctgtgaaaaacacgctgtgaagcgaatccatcagtgacgttttcaaaaccggcacgatatgggaagaaaatgcggccgggatctgcttaatcgattcctgactgaacaaggattgaagcagcccttcaggatttttgtcaatcatacctttaaactgggcggcaaaggcacttgcctgtttcgggagtgagtctaagtaaggcaccagtctgtcggttaaaaggcttcctgatctggcattcatgacagcgccgagcaccgtaatgccgaacgttcccccgatcatccggaaaaattggcttgatgaagtcacaacgcccagctcttcttttgaaaacgtttcttgcagagcgagtgtgagaagcggcatgacgagccccattcccagaccgatcactgccatatagcacgtagccgcgagcttgcttgtatccagctgtaaggtcgttaataagaagaagccgacggccatgatcagcatgccgatcatgatttgcggtttaataccgatcttataaaccagctggcctccgataatacttgtgataatcatagataccatcatcggcgtcataatcgtgcctgacgcggtggcgctgactccgataattccctgcataaagaaaggaacgaacgtaacggcgccgaacatgccgatactcatgaaaaacccgatcagattcagtacggtaaacgttctgtttttaaacaggtacatcggcagaatcggttcttttgctttgatttcagcgaaaatgaatccgacaatcccggcaagcgcaagcgcaaagagaccgagaatctgccaagagccccatgcgtaatcttttcctccgaagctgagcgcgagaaggaggctgacgattccgacaatcattgtgaaaatgccggcgatgtcaaagttaatcggcccagtctgttttctgccttgaagtcctcttgcgataaagatcacggctaaaattccgacaggcaggttgatatagaaaacccatttccaatttaatgagtcaacaatccagcccccgatttgcgggccgataacggaagcaaggccgtaaatcgctccgaaaagcccttggaacttggcacgctgtttccctgtgaacaaatccccaatgacgatcatggccatcggcatcatgacaccgccgccgattccctgaagtccgcggaaaataatcagttccgtcatgttgctggccattccgcacagtgcggaagctcccataaaaatcaataaacctgacacatagacgacgcggcgccccaataaatctgcaagtttccccgcaatcggaacgatcgtcgtcgaagttaaaagatatgccgtggtcagccacgtcatcatgcttaatcccccgaggtcacccacgattttaggaatcgccgttcctacgatggtgccgtcaagggctgagaaaaacatggcgatgattaagcccgttattaataatgtgcgttttggatctttcttttcaatgctcatgtttcggcagctcctctttctattcgttttctttttgatcagccgcgtatttctcggcggcttccgctactttgcggatgatgttcacggactgaatcagttcatcgtcagtcagaacggacaggttacgcgccagtatcgctttccgtccttccacaacatcttcgaattttgtttcgccttttttggtgaggctgatgtcgatgacgcgtctgtcctgctggttatgtttgcggacgataagtcctttttgttcgaggcggtcggccatcagcgtaaccgcgctcggctttacctccatgcgttccgcaatttcggaaactttgcagctcccgtgttttttcaggctggctaaaacaaataattgggcaggcgtcacctcgtgttttgccatgctttccaccatttcaggctgtatgttttgcagcagcgtctgaagagatttctggatgtcagacacatattgatccgcgtttttcataactcctcctcatcttgttccttgagaaaataattaacattagttaaatataaataaggattaatgataagtcaatctttttgtgcaaaaataaaaaaaggactgatgcttggcgaaaacatcaaatcctttttcattttactgctggtagggagactgctgctgaatggtctgccggaacttctgatacgattgctgaagcttttgggtatcggcggcttcaatggaataccagccattttgaaacatcacatcgtataatcttctttgcgctttttgtgactcatcgaaaatcgcctgaatatcttgataaagagactcgtggctgaactcgtgcagggctgtgcaatatgaagccgtgatgtatttttccgtcgtcagcagctcattgaccaagtctctgtcattcatttgcgccgtattgggcacgggcgtttgcggattcgtgattttttgattttgctgttccatgtattgtcctcctattgcatatagcctgttgttgtctgtccgccttgaccggggttcaagcggcccaatatgtgctgataatgcttctcatgcatccggccgatctgatcaagctcttgttttaacgtctgattctggcagtgttccgccataaaatgcgcttttttcatggcaagcagattccagttcagcatgtcctcaagatacaaatggtctttcgttgagatgacggcaggcggcaagtttccgtgctgctcttggttgttcatataaacgcctccttcaattctgttctttttagctttctctgcgatcgggatttcatacagataaattaaaataaccacgatttgcaggagagacatcaatatttacaataaaaaaagacactatcagaagaaaaaaccttcggataatgtctgttcatgttaacagttcgatatatgcgaaagtcagcagcggcactaggattggacttcagctgccggtttattgtctagatcagtgccggcttttctttcagttatttttatttttggtaaaagaaaagcagaaaatactccggcaattaatagtataagccctgcgaaaaatacactgcgaagagagtccattaacgctgtcttcattatcggtatgatgtgctttgctatagaatgcggaaattgttcgaatgaaccagaactgaatagcctctgtagcaggacttgaggattgctgctgatcaagtctttgagatgagctgctaatgcgttttcttgttttggaaaattgtctaaaaaaggaactaatttatcggttaatatatttcctgacttggcattcatcactgctcccagaatcgtaattccaaacgtacctccgatagagcggaaaaattggcttgacgaagtaaccacgccgagcgtttctttagagaaactctcttgaagtgccagagtaataatgggcataacaaggcccataccgaagccgatgatagctacataagtagttgcagttaatttgctggtgtcagcttctaatgtggataataaaaaataggcaaaggatatgattgccatccccgtgataatctgcgctttaatgccgattttaaagaccagctgcccgcctataatactggagataatcattgcgaccatcatcggcatcatgattgtcccggactctgatgcactcatgccgattattccttgcatgaagaaagggacgaaggtgattgctgcaaacatcccaatactcataaagaaccctattaaatttaagaagataaaagttctgctttttagaagatgtataggcagaattggttctgcagcttttttttctgcaaatacaaaactaataatacttatagtggccaaagctaacagacaaaatgtctgccatgataaccagtcaaattcttttccgccgaaactgagtgtaagcagcaaacagactacacccgtaatcattgtaaacatcccgatgaagtcaaaatgaatcggacccgtgtattttctggcctgcaatcccatcgcaataaagaacacagctaccattcccacgggtaaattgataaaaaatacccaatgccagctgaaagaatctacaatccatcccccaatttgcggaccgattacagaagcaagagcgtaaataccgccaaatacgccttgaaatctggcacgctgtttgcctgtgaataaatctccaatgacaatcatagccatcggcatcataatgcctccgccaagaccttgtaaacctcgaaacacaattaattctttcatgttatcagccaggccgcacagtgaagagccaatcatgaatataatcagcccggccacatatactgcccggcgccctaatagatctgcaagttttccagcgatcggaacgatggaggtagatgttaataggtaggccgtagtcagccaagtcatcatgctcaggccgccgagatctcctacaatcttaggcataaccgttcctacgattgttccgtccagagcagaaaaaaacatagctataataagtccaattaataaaagtgtacgtttagattttcctgttgaatccaattgaaggttccctcttttcatatgtttcgagcttagtgattcttcaaaataaggtgaatggataactcaggcaggtcccttctttaaattccgttagggaagagaagccatctttaaagatgaaggatcgtaaagctattagaaagaaataataatgctttggaggtatgtttgtgaggcaaagataaattcagcagaattatcattttgaaattctgcttttccttcttaatagatacgttcaataaactgaattatcaattttaaatataagccattgtaaattataaatcaattatcttttaaggaatattttcaaattataaggggataaagaaatataaattataagtttttttgggcgaaatgtaacgaagaagcggaattatagctcgaaaactcaattgaagaagtagtgatttttattgatcctttttgtgactcattaaaaccgtttgaatatcttgataatataatacattgctttgacatcagagtctgtatggatatatgaatgatatcttggcaatctgcatggcttttgtgttttagctttctctgcgatcggaaattcatacacgaataaaagaaaaaggagggagttcatccttgctgcggagcatatgtttatttttgtcgaaaaataaaatgcttacaaaattcgcccaggcttacggaatccgcttcggcgcgggaaggttcgttgcaggggaaacgctcacggaagctgtgaaaacggtaaagcggctgaaccaaaaagggctgtcggcttcgattgattatctaggtgaatatgcgggttcagagaaggatgcgaaaaagacggcggaagaatgtaaaaaagcaatcagggcgattgccgagaatcaactggattgtgagctgtcgctgaaattaacatccatcggtctggatatttccgaggaactcgcggaacagcatgtcagagacatattgacggaggcaaaagaacgcggcgtgcctgtaacgattgatatggaggactattcaagatgcggccgtacgcttgagctgtataagcggtgcaagccggattttccgatgctcggcaccgtcattcaggcttatttataccgcgcagctgaagacatcagcggtctgatgccatataagccgcggctcaggcttgtaaaaggcgcttataaagaatcggcggccgttgcgttccctgataaaaaagcaaccgatcttcattttcagcagctgattaagctgcagcttttgagcggctatgaaacggcggtggcgacacatgatgacgatattatttcgtatacgaaaacactcatcagcgagcatcagattccccgggagcagtttgaattccaaatgctgtacggcatcagaacggagcgccagaaggagcttgccgaagaaggatacaggatgagggtgtatgtcccgtacggaaccgattggtacgggtacctgatgagaagaattgccgagcgcccggcaaatgcggcgtttgtgctgaaaggaatcttcaaaaaataacggctgctccaaaaagcagccgcagtatgttattccatgttgtcttttttatattgctgattttggctcgtccgtttgccgccgccgtatttttgcttcggtcccgcatttcctttcatgctggccgcgctcactgcggcagaagacggatcttttctccctcgcaccattcccttcacctccgggtttaagtttcccgcccgcgccatggaacatgcggaagccgaaaaatttaaaaaaattccatatttgctattgaagtcatcctgaaaatcttttaagatgaaagaagaaaagggtttcattttttttgccgaaaaaatgaatgactattcattcaaagttcaagggggatgactcatgcacaagtttataaagaaagcagccgttctcggatcaggcgtcatggggtccggaattgccgcgcacttggctaacatcggaattcccgtcctgctgcttgatattgtgccaaacgagctgacaaaggatgagatgaaaaaagggctgacattagaaagcccggaggtccgcagcagactgagccgatcggccatgcaaaagctgctgaagcaaaaaccggcgccgctgacttcggctgccaatctcgactatataacggcggggaatttggaagatgacgcagctcaattgaaggatgctgattggattattgaagtcgtcgtcgaaaaccttgacgtaaaaaaacagattttctcactcgttgatgaataccggaaaccgggaagcatcgtgtcgagcaatacgtccggtatctccgtcacaaaaatggcggaaggccgatctgccgattttaaggctcatttcttaggaacccatttctttaatccggcccgctacttgaagcttctggaaatcattccgattcaggaaacagatcctgacgtgctggagtttatgacttcatttgcagaaaacacgcttgggaaaggtgtcgtcatcgcaaaagacacgccaaactttatcgccaaccgcatcggtacgtacggcctgctggtcacggtaagagaaatgctttcttccggctgccgcatcggcgaggtggacacggtgaccggacctttgatcggcagaccgaaaagcgcgaccttcagaacccttgacgttgtggggcttgatactttcgctcatgtggcaaaaaacgtatatgataaagccgacggcgctgaaaaagacatgtttaagcttcctgaatttatgaatgacatgctgaaaaacaattggctgggcagcaaatcaggccaaggtttttacaaaaaagaaggtaaaacaatatatgaactcgatccgctgaccatgacatacggtgagcgctcgaaaatgaagacgcccgctttagaagccgccaaacaggcaaagggtgccaaaggcaaaatgaaagcgcttgtatattccgatgaccgcgccggacgcctgctttggaatatcacatcgcaaacactcttatactcagcccggcttttaggtgagatcgctgatgatataaaagcaattgatgacgccatgaaatggggcttcggatgggagctcggaccgtttgagatgtgggatgccatcggcgtcagaaaatcagcggagcggctcgaagaagaaggcgcagcactccccggctgggtgaaagaaatgcttgatcagggtcatgaaacattttatatgaaggaaaacggaacacaattttattattcagacggccaatacagggctgtgaaagaaaatccgaaacggatcagcctgcagacgttaaaagaaacaaaaggcgttatcactaaaaacagcggcgcaagtctggttgatctcggcgatgatgtcgcgctgctggaatttcatacgaaaagcaacgcgatcggcttagacattattcagatgattgacaatgcgcttgaggaaacggagcggaattataaaggtcttgtcatcggaaaccaaggcagacatttctgcgcgggagcaaaccttgcgatgattttaatggaagcccaggatgataacttcatggaagtcgattttgtcatccgccgttttcagcagacgatgctgaacatcaaatacagcgctaaaccggttgtagcggcgccattcgggatgacactcggcggcggcacggaagtctgtctcccggcggcacgcgttcaggcggcgagcgaatcgtatatgggtctcgttgaaaccggcgtcggtcttattccgggcggcggaggaaacaaagagctgtacatgaattatctggacggcggaagtgaactcatggacgcagcgattaaaaccttcgaaacaatcgcgcttgccaaggtgtccggttcggcacacgaagcccgtgacatgaagattttgtccgcggcagaccgtatcagcatgaatcaggatcacctgctgcacgatgcgaaacagctggctgcttccttatatgacagcggataccgtccgcctgcccgcaaaaaagtgaaagtcaccggagaaaccggctgtgcggcattactgctcggagcagaccaaatgagacggtcgggttatttatccgatcacgatatgaagattgcgaagaagctggcccatgtcattgccggcggaagagtcccgttcggcacggaggtttcagaagaatatttactcgagattgaaagagaagcctttttaagcctcgctggcgaggcgaaatctcaagcgagaatgcagcatatgctcgtcaaaggcaaacctttacggaactaggagggtgtttatgagagaagcagtcattgtggccggtgcgagaaccccggtcggtaaagcgaaaaaaggatcgcttgcagccgttcgtcctgatgatttaggcgcgctttgtgtaaaagaaacgctgaaacgggcaggcggctatgaaggaaatatcgatgacttaattatcggatgtgcaacacctgaagccgaacaaggattaaatatggctcggaatatcggtgcgctggcggggcttcctcatacggtgccggccattacggtgaaccgctactgctcttccgggctccaatccatcgcttacggtgctgaaaaaattatgatcggcgcgggtgataccgtcattgcgggcggtgcggaatccatgtcgcaagttccgatgatggggcatgtgacacggccgaatatcgctttggcggagcatgcgcctgagtattacatgagcatggggcatacggcggagcaggtcgccgaaacgtacggagtatccagagaagaccaggatgcatttgcagtccgcagccatcagaatgccgcaaaagcccttaaggaagggaaattcaatgacgaaatcgtgccggttgaagtatcgctgacagaagtcggtgatgaccataagccgcggaaaaaacaatttaccttttctcaggatgaaggcgttcgtcccggcacgtcggctgacgtcttggcgaagctccgcccggctttttcaaaaacgggaaccgtgacggccgggaactcttcacaaacaagtgacggcgcggcggctgtcatgctgatggatcgcgaaaaagcatcgtcgcttggattggccccgcttgtcaaattccgttcctttgccgtaggcggcgttccgcctgaagtaatggggatcggtccgattgaagccattccgcgggcgctcaagcttgccggactcgaattacaggatatcgggctttttgaattgaatgaggcctttgcttcacaggccattcaagtgatcagatcgctcgggatagatgaagaaaaggtgaacgtcaacggaggcgccatcgcgctcggacatccgctcggctgcacggggacgaagctgaccctgtcactcattcatgaaatgaaacggagaaacgagcaattcggcgttgtgacgatgtgcatcggaggcggcatgggcgctgccggcgtatttgaactcatttaaaaaaagggggaaatgaacatgaaacaggaaacggtcaacgtcaaaaaaggcggcagctttctgattgaagagacgggatatgatcaaatattcactccggaggactttacagacgaacataaaatgatcggcaaaacgacagaagactatgtcgtaaacgatgtgcttccttatatcgatgaaattgaaaaccatcagtttgagcattcggtcagactgctgagaaaagccggagatctcggcctcctcggagcagacgtgcctgaagagtacggcggaatcggcctggataaaatcagttcagccttcattacggaaaagttttcacgtgccggcagcttttcgctatcttacggcgctcacgtcgggatcggttcattgccgatcgtgttcttcggaacggaagaacagaaaaaaacctatttgccggacttggcttcaggacaaagaatcgcggcatacgccttaactgagcccggttcaggttcagatgccctcggcgcgaaaacgacggctgttttgaatgaagcgggcacacactatattcttaacggagaaaagcaatggattacaaactccgcctttgcagatgtctttgtcgtctacgctaaagtggacggagataagttttccgcatttatcgtagaaaagaactatccgggcgtatcaacgggaccggaagagaaaaaaatggggattaagggttcatcgacaagaacgctgattttagatcaggcggaagtcccgaaagaaaatcttctcggcgaaatcggaaaaggccatgtcatcgcctttaatatcctgaatatcgggcgctacaagcttgccgtcggcacaatcggcgcttcaaaacgggtgattgagctgtctgccgcttatgcaaaccagcgccggcaatttaaaacgccgatctcaagcttcacgctcactcaggaaaagcttgcgacgatgtcagcgcggctttacgccatggagagctctgtatacagaacagtgggcttattcgaagataatatgagcagactgacggaagaggagcaaaaagacggacgcgaagtcgcgaagtccatcgccgagtacgcgattgaatgctcgctcaacaaaatgtgcggttctgaaacgcttgattacattgccgacgaaggggttcaaattcacggcggttacggatttatgcaggaatatgaagtggagcgcgcctatcgcgactcaagaatcaacaggatttttgaaggcacaaatgaaatcaaccgcctgatcgtaacgagcacgtttctgaaaaaagccgtaaaaggtcagctgccgctctttgaaaaagcaaaagcgctccaagaagaactcatgatgctgatgcctgaagagccgggctcagaacctcttgaacaggaaaaatacattgtcagacaggcgaaaaagatcgccctcttgacagcgggtctcgcggcgcagaaatacggcaaagagattgaaggcgagcaggaaatcatggtgaacattgccgatattgtcagcgcgctgtatgctttggaatctgccgtcctcagaacggaaaaagcaattgcggcggacggtgccgaaaaagccgcgcagaagctgttatatacggaaatctttgcccaggaagcccttcagaacattgaagcgcacgccaaagaatcactgatcgccatggaggaaggagattccctccgcatgatgctttccgtgctgcgcaaactgacgcgcctgacgccgaaaaacctcattcagaaaaaacgtgaagcggcagcagccgtcttccgtgaagaaaaatatacagtctgatcacatgctgaaagcgctccttcatcaggggcgctttttcatgaagcaacgttataggtttttacaagtgattgtgttaaaataacgacgatcatttacaaggggtgaagaagatgtcgttaaatttttactggtaccctaaatgcggaacgtgccgtaatgcgaaaaaatggctggaagaccgcggtaaggaaataaacgaaatacatatcgcggaggaaactccgtcgaaagaagaaattaaagacctctatgaaaagagcggtcttgagctcaaaaagtttttcaacacgagcggaatgaaataccgcgagctgaacttaaaggaaaaactgtaccatatgtcagaggatgaacagctcgaacttctggcatcagacggtatgctcctgaaacgcccgattacgacagacggcgaaaaagtcactgtcggctttaaagaagaccaattcgaaaaatattggatgtaatgccaggttcaaagaattatggtatcttcttattataagaaaaaaatggagggatttagatgagcacaccgaaagatatgcgttattccaaagagcacgaatgggtcaaagttgaggacggaaaagcccgtatcgggattacacatttcgcgcaagccgaacttggcgacatcgtatttgtcgagcttccggaagtcggcgccgaaattaaagcggacgagccattcggcagcgtggaatccgtcaaaaccgtatccgaactgtacgcaccgattaacggaacggtgacggaagtgaacgaagaccttgatgacagtcctgaattcgtaaacgagtctccgtatgaaaaagcgtggatgatcgtcgtggaaccggctgatgctgaagaaatcgaaaacctcatgacttctgagcaatatgacgaaatgacacaggaagactgatcggatagcaaaggggccatttggacactctatctgtaacgggaggtgtctaaaatggcttttgataaacaaaaggtcgatgtgacggagaacgtcacgggccgctttcaaaacggccggttttccttgtttcatgaaaatgaagccatcggcgagatgacaggcatggaccagtacgagctcaaacagggcttttcatttgaaaatcaaaaattttataaaacagccgatgtcataaacggcagcgatccgaaatatgtcgattgcgattatgagaatggctggtgttaacagttggcggtgaatttcactgccttctttttcaatctgacgctaaaacaatcggcaggtgacgcgcttatgtacaacggagatgaaaaggtcattatcgtagaaggaaaatctgataaaatcaaagtcagggaagtgctcatcgaacccgcggaaatcgtctgtacaaacgggacgatcggccaaaccgaactggaagagttggcggaccgcctgtttgacagagacgtctatattttaacggacgcagatgactccggagaaaaattaagaaaacagctgaaacgggagcttcccgaagcgcgccatatttatatagacagaacatacaggcaagtcgagtcgtgcccgggccatcatctcgcatctgtgctgatcagagccggctttgatgctgacactgtatttttgaaaaagaacgacctgaggtggtaatcatgaaagaactccaagaaaatgaactcgaatcgattcaggatgacgtttatctcctgtatttgtacaccccgttttgcggcacatgccagctggcgtccaaaatgcttactgtcgtcgaagaaatgctgcccggtgccgccttctataaaaacaacgtgaattattcccccgcattcgccaaagcctatcagattgaaagcgttccgtgctttttgctgtttaaaggcggagagcttgttgagaaaggatacgccttccgctccgtttcctatttatatgagctgattaaacaaaaaacatcgcaaacgttcccgatgtgacaatatttacaggaaaatgtcgtgcggtttataaagggttctgtccgttaaaaagagaaagtgtatgtatggccattaaaacgggaggttatacgagtggagaaaatagaagtttcagagaatgacggacagcatctgtttttgaaaccgctattaaacgcctcaacgctgctgattacattccaaggagaaacagaagccttaacggtctcaattaacggacagggagaaatgagaaaaacgtcggcttcaaaggagaaatctaatttgaccttttacggaaaccagacggaaatcatccatctcctgcatggtgatgtctctttgcaaaagcttatccaaagcggaaaactcaaagtgaaaggatcattcagagccctgctgaagctggaggccatcctctggctgacaaacggattttttcaggcgatcagtaaacggccgtaactgccaatctactatgtgacaatagcttccaatatttattttattgactttttatcattcgccgtgctattctacagtaagaatttccggacgaaaatacgatatgttttctcttatcaagagaggtggagggaagtgccctatgaagcccggcaaccatcaacaatgttgaaatggtgccaattcactcaaagcggtctgctttgaaagatgagagaaaggcctttttcaataagcctttctgctcatttttgcagaaaggcttttcttttgcggagaaacccggaagatttcttagaatagtgtaaggcgggtgattgctttgatccatcttcaaaatgtttcaaaaatttacaaagcgaagcatggggatgtcaatgctgtccaagatgtcactcttgatatcaaaaagggcgaaatatttggaattataggatatagcggagctggtaaaagttccttaatccgtctcctgaacggccttgaaaagccgacgtcgggaaccgtggaagtcgcggggacggaattaaataaagtaagcagccgcgggctgagaaaagcgcgccaggaaatcagcatgatcttccagcattttaaccttttgtggtcgcgcaccgtccgggagaacattatgttcccgctggaaatcgccggcgtgaaaaaaagcgaacgggtccgccgcgctgatgaattgattaaactggtcggattagaggggaaagaaaaatcttatccgtcgcagctgagcggcggtcaaaagcagcgtgtcggcatcgcccgggcgctcgccaataatccgaaagtccttctgtgcgatgaagcgacatcagcgctcgatccgcagacgaccgattcaattttggatcttttatccgatataaatgacagactcggtctgacgatcgtgctcattacccatgaaatgcacgtcatccgaaaaatctgcaacagagtcgccgtcatggaaaacgggaaagtcgttgaagaaggcgaagtactccaagttttcagaaacccgcgcgaaccgatgaccaagcgtttcgttcagcaggtgacagaaccggaggagacgaaagaaaccatccagcattttctgcaggaaacagcgacagggaaaacgattcagctttcatttgtcgggcaggccgccgagcagcccctcattacggaaatgatccgaaactttgatgtggacgtcaatattctgcaggggaaaatttcacagacgaaggacggagcttacggttcattattcattcatattgacggtcaggaaaaagaagtagaaaacgtgatccggttcatcaaagacaaacaggtagaagcagaggtgatcacaaatgtttgaaaaatggttcccgaacgttgatataaccgagctgtggacggccacatatgagaccctttatatgacggtcatcgctttagttttttcatttatcatcggagcgattctcggtcttctgctctttttaacgggcaagggaagcttatgggaaaataaaatcattaacaccgtgattgcggcggtcgttaatattttcaggtctattccgtttcttattttaattattctgcttctcggctttactaagattctggtcggatcgattttaggaccgaatgccgcattgccggcgctgattatcggctccgcgccgttttacgcccgtcttgcggaaattgcgctccgggaagtcgataaaggagtcatcgaagctgccagatcaatgggagcaaagacatcgacgattatcttcaaagtgctgattcctgaatcaatgcctgcgttaatttcaggcatcaccgtgacggccatcgccctgatcggatctaccgccattgccggcgccatcggttcaggcggactcggaaaccttgcatatgtagaaggctaccagtccaataatacggatgtaacgtttgtagcgacagtatttatactcatcatcgtctttatcattcagattatcggtgatgtaattacaaatataatagacaaaagataagggaggatttacattgaaaaagattgtattaagtgcgctgctgcttgtgttcgcgggagttttagccgcctgcggatcaaacggctcgaataaaaaggaaatcgttgtcgccgcgacaaaaacaccgcatgctgaaatcttaaaagaagcggaaccgctcttgaaggaaaaaggctacacattaaaagtaaaagtgctgaacgattacaaaatgtacaacaaagcgttagctgataatgaagtggatgcgaactacttccagcacgttccttaccttgaacaggaaatgaaagaaaataaagattacaaactcgtgaatgccggagccgttcaccttgagccgttcggagtttacacgaaaaaatacaaatcactgaaagacctgcctaaaggcgcgaccatcatcatgactaacaatgtcgctgaacaaggccgtatgctggcgatgcttgaaaaagccggactgatcacacttgatccgaaggtaaaaacgattgaagcgactacgaaaaacattacgaaaaacccgaaaaacctgacattcaaaaaaatcgcccctgaattaacggcgaaagcatataatgaagaagaaggcgatgcagtcttcattaacgtcaactatgcgattcaaaacaaactgaatccgttaaaagatgcgattcaagtggaatcaacgaaaaacaacccgtacgcaaacatcatcgccgtacgcaaaggtgacgaaaaatcagagaaaatcaaagcgcttatggaagtccttcactctaagaaaatcaaagactttattgagaaaaaatacgacggagccgtgcttcccgtatctgaataaagcgaaaaccccggatgaatcatccggggtttttttcgggtattaatcggagaactgtccataataaaaaggaaggttaacgattggagggaatggcagtggctcaataccaggataacggaaaaagcgtgcatgacgcattgaaacaatataaagaaggtttaggcatattcgagcaaaaaatgcccatgatggggcggaagtttaatgaatttactgagcagtgtttctcagcggattcattaactgaaaaagagaaacaattaatcgctctgggcatcagcatcagcgctcaagatgaattttgcatgatttatcatacgaagggctgccttgaccaaggggccacagaagaaaacatccttgaggtcatcagcgtcgcggcggcattcgggggcggcgcggctctcagtcagggagtgaccctcgtgcagcagtgtattcaggaattcggacatacgacgcattagaatgagcaatcgtgtgaataccgtttttcagataaagcgagcgccggtttccggcacattcgaaaggattcaggggcacaccctctttggccggagcagcggatcattgttacaatagaaacaaatatatgaagggattgattcattatctgcaccagccacgagagactggaccttgactatacgcctgaaatggaaaaagcgatgcagaagtcacacggcatcggctacgaggaatacggacggcgtctttcaaaaaggatggaagtcgaacggcagagggagcttgaatatcaaaaaagcaagttcctcgcagcgcagcttaatgagaaaatcggtcagtaaaaaagggtggatttccgccctttttctgtttcaaacagctttaattacgccttgatctttgataaactttaggaatgttccgggtaatataaaaagttgtatttacttttcatttgttataaaattagaatgagaataaattgagaataatgattatatattttggaggtatagatatggctgcttcaacattaacgatcaaggatcttcacgttgaaatcgaaggaaaagagatcttaaaaggtgtaaaccttgaaataaaaggcggcgaattccacgctgtcatggggccgaacggtaccggtaaatccacgctctcagcagcgattatgggacacccgaaatacgaagttacaaaaggaagcatcacgcttgacggcaaagatgtactggaaatggaagtggacgagcgcgctcaggcgggtcttttccttgcgatgcagtacccaagcgaaatcagcggtgtgacaaatgccgatttccttcgctctgcgattaacgcacgccgtgaagaaggcgatgaaatttctcttatgaaattcatccgcaaaatggacgaaaacatggagttccttgaaatggaccctgaaatggcgcagcgttacctgaacgaaggtttctcaggcggggagaaaaaacgcaacgaaatccttcagcttatgatgatcgagccgaaaatcgccattcttgacgagatcgattcaggtcttgatatcgatgcgcttaaagtcgtttctaaaggaatcaacaaaatgcgcagcgaaaacttcggctgcttaatgatcactcactaccagcgccttctgaactacatcacgcctgatgtcgttcacgttatgatgcaaggacgcgtagtgaaatccggcggcgcggagcttgcacagcgccttgaagcggaaggttatgactggattaaacaggaactaggcattgaagacgaaactgtaggccaagaagcgtaagcgttagggggataatcatgacattggaaacgaaactatccgtagatcaggaatatgtcaaaggcttttccgaaaagcatcaagaacctgcctggctgaaaaacctgcgcttacaggctcttgaaaaagctgaagatctgccgctgcctaagcctgataaaacaaaaatcacaaattggaactttacaaagttcaacaagcatacagtagaaaacgcgccgcttgcttctttagaagatttagctgatgaagcaaaagcgctgatcgatatcgaaaacgaagataaaacgttatatgtgcagcgtgatcaaacgcctgctttcctttctctttcaaaagaactgaaagacaaaggcgttattttcacggacatcttaacggctgcccgtgagcacagcgacctcgttgagaaatacttcatgaaagacggcgtaaaggtcgacgagcataaactgactgcgcttcatgcggcattaatgaacggcggggcattcctttatgttcctaaaaacgttcaggtggagacgcctgttcaggccgtttacgttcatgaaagcaatgacacggcattgttcaaccacgtgctgatcgtcgctgaagaccacagctccgtcacttacgttgagaactacatcagcacggtgaatccgaaagaagcggtattcaacattatcagtgaagtggtcacaggtgataatgccagcgtgacgtacggcgccgttgacaacctgtcagcaggtgtcacaacatacgtcaaccgccgcggagccgcgcgcggacgagacagcaaaatcgagtgggcgctcggactgatgaacgacggcgacacgatttctgaaaacacgacaaacctctacggagacggcacatacggcgatacgaaaaccgtagttgtcggaagaggagaacagacggaaaactttacgacgcagatcatccacttcggtaaggcttctgaaggctatatcctgaagcacggagtcatgaaagatgccgcatcttccatctttaacggaatcggcaaaatcgagcacggcgcgtctaaagcaaacgctgaacaggaatcccgcgtcctgatgctgagtgaaaaagcacgcggagatgcaaacccgattctcttaattgatgaagacgatgtaactgcaggacatgcggcatctgtcggccgtgtggatccgatccagctttactacttaatgagccgcggaattccgaaagaagaagcggagcgcttagtcatttacggattccttgctccggtggtaaaagagcttccgattgaaggagttaagaaacagctcgtctccgtcatcgaaaggaaagtaaaataatgaatatcaccgatattcgtgaacagttcccgatccttcatcagcaagtgaacggacatgacctcgtgtaccttgacagcgcggcgacttcccagaagccgcgtgctgtcattgaagcagtggatcagtattacagcaaatacaattccaatgtccacagaggcgttcatactcttggcacgagagcgacagacggctatgaaggtgcgcgtgaaaaagtccgtaagtttatcaatgcgaagtcaatggctgaggtcattttcacaaaaggcacgacaacttcactgaatatggtggcgctgagctatgcccgcgccagcttaaaacccggtgatgaagtggtcatcacccaaatggagcatcatgcgaatatcattccgtggcagcaggcagtaaaagcaaccggcgcgactttaaaatatatcccgatgcaggaagacggcacgctttcgctggacgacgtccggcagactgtcacaagccatacgaagatcgtggcagtcgctcatgtgtcaaacgtgctcggcacgattaacccgattaaagagatcgccaaaatcgctcatgacaatggcgctgtcatcgtggtggacggggcgcagagcacaccgcacatgaaaattgacgttcaggacctggattgcgacttcttcgcgctttcttcccataaaatgtgcggcccgacgggaatcggcgtgctgtacggcaagaaagaactgcttgagaatatggaaccggccgaatttggcggcgaaatgatcgactttgtagggctttatgaatcaacttggaaagagcttccgtggaaatttgaagcaggcacgccgattatcgcaggcgcgatcggattgggagccgcgattgattttcttgaagagatcggactcgacgagatttcccggcatgagcataagcttgcagcctatgcgcttgaccgtttcgagcagctggacggcgtgacggtatacggtccgaaagagcgggcgggacttgtgacatttaatcttgatgaggttcaccctcatgatgtcgcgactgtcctcgatgctgagggcattgcggtcagagccggccatcattgcgcccagccgctcatgaaatggctggatgtatctgctactgcgagagcgagtttttatctgtataatacagaggaagagatcgataagctcgcggaagccctccaaaagacaaaggagtactttacaaatgtcttttaatgcaaatttagatacattatacagacaagtgatcatggatcattacaaaaatccgcgcaacaaaggggttttggatgacagcatcgtcgtcgatatgaacaacccgacttgcggcgaccggatcagactgacaatgaagcttgacggcgataccgttcaggaagcgaagtttgaaggggaaggctgttccatctccatggcttcagcttccatgatgacgcaggccattaaaggaaaagatattgataccgccctttccatgtctaagattttctcagacatgatgcaagggaaagagtatgacgactcaatagatctcggggatattgaagcccttcaaggcgtttcgaaattcccggcccggattaaatgtgccaccctttcatggaaagcacttgaaaaaggagtcgctggcgaaaaaggcggcaattaaaagattggagtgaaaatggatggctaaaaaaatgcctgaaattggtgaatacaagtacggttttcacgataaggacgtttccattttccgttcagagcgcggattgacaaaagaaatcgtagaagaaatttcacgcatgaaagaagagcctcaatggatgcttgatttccgcctgaaatctcttgagcatttctacaacatgccgatgccgcagtggggcggggatttaaactctttaaactttgacgaaattacgtattacgtaaagccgtctgagcgttcagagcgttcttgggatgaagtgcctgaggaaattaaacagacatttgacaaactcggtattcctgaagctgagcaaaaataccttgccggtgtttctgcacagtacgaatccgaagttgtgtaccacaatatgaaagaagatcttgaagcgcaaggcattgtcttcaaagacacagacagcgcgctgaaagaaaatgaagacattttccgcgagcactgggcgaaagtcattccgccgactgataacaagtttgcggcgctgaactcagctgtttggtccggcggatctttcatctacgtgcctaaaggcgtgaaggttgaaacaccgcttcaagcttacttccgcatcaactctgaaaacatgggtcagttcgaacgtacgctgatcatcgttgacgaagaagcaagcgttcattacgtagagggctgtacggctcctgtgtacacaacaaactcgcttcacagcgcggttgttgaaatcatcgtcaaaaaaggcggctactgccgttatacaacaattcaaaactgggcgaacaacgtttacaacttagtaacgaaacgtacggtttgtgaagaaaacgcgacgatggaatgggttgacggaaacatcggttctaaattaacgatgaaatatccggctgtcattctgaaaggtgaaggcgcgcgcggcatgacgctctctatcgctcttgcgggcaaaggacagcatcaggacgcaggtgcgaaaatgattcaccttgcaccgaatacgtcatccacaatcgtatcaaaatcgatttcgaaacagggcggaaaagtaacataccgcggtatcgtccacttcggacggaaagcggacggcgcccgttcaaacatcgagtgtgatacgctcattatggataataaatcaacttctgatacaatcccttacaatgaaatcctgaacgacaacatttcattggagcacgaagcgaaagtatcaaaagtttctgaagaacagcttttctacttgatgagccgcggtatttctgaagaagaagcaacagaaatgatcgttatgggcttcatcgagccattcacaaaagaacttccgatggaatacgcagttgaaatgaaccgtttgatcaagttcgaaatggaaggctccatcggttaatagtaaaaccccgccatatggcggggtttttttgtttattgaatagtgaaatttccgtattcgcttgaccggacatgaatcggcccgtttaaattgtagttcttctctttgacaatatcgcggaaaacgtcgacacgggcaaccgattctctccattcatcctgggtgtcctcatctgccggattcatcagatcgtcatagcgtacatccaagaatttattgagccatttcttctcgtccgttccgtctttcggtgacccgcccatttttttgttcgtgcgtttaatcagggcataaaaggagtctggatcatcaccgtcaccatgctgaatcaccgtatcgtacatcaccgctttggccaaggccgttttcagtccggcattttctgaacgtttcatcgccggctgataatacaagctgtcgtttaccttatcctgggcagcgcggaaggctttatcattgccaagtgagcgccaggcagaagcgaatcctttcagattgctgatgtcatcgctttcgtccttcgcaagacgacgcaattcaggcaaatactttttcaatttgttattcggcaccgctttcgtatatacttcgactacttccagcgcatctccggtagccgtcgtaaagccggcccgcccgcaagtgtaacctcttccgtcatccaacgcttcaacatatccgtattggatttccgtctttccgttttcaaaaatgctggtcagctgttccgcacggcgcttctgatccttattcagcccggccgcaaaaaccgtaccgctcatcatcagggtaaaaaacatggtgaaaataagagatgaaaccgccgtcttcttccaaaaacctgcttttttcttcaaattgattttcattgccatacccctttcatatgtaagttacgcactcagtatacatgagggggtgatttttttgttgaaaacacacgaatttgtcaatattttgaatcctaagccctatccagcgcttcataaaaagaacgcaccaccttcaccagacagacaatcccgttctcgcatcattcttatctgtaacatagtcaacgcggtgaaacccgcattgtacagcctgctgaaaaagggcttcgagcatgtccggatctttgcaatataacgttacatacgagcaatctgcgatgagaagcacaagttcacaggaactatccaaatattctcatacgtattgatttccgttaccatcccgctcgggaaagctttcaattcagcacacaacatttcaggcagaaaagagagggaacgggcgatcacggaaatggtgagggtgctgaagcctggcggcacattggccgtgtcagatataaaaaatacatcacaatacagagcaattcttgaggaaaacggctttcagacaagaacgtattccttttattatacgtttccgttttcgaaacttatcattgccgtcaggactccggtaggaaccgggcgctctatttgttaaaataaataagacaaaacagatagaaaaggtgttacacatgaagtcttatatgattatcggagccggcattctcggtgcgtccgcggcttatcatctcgcaaaggccggtgcggatgtaacggtctttgacaggaaacacccggggcaggcgactgacgccgctgcagggatcgtctgcccgtggctgtcgcagcgccgcaaccaggcatggtatgcgatcgcaaaaggcggagcccgctattataaccaattgatacagcagcttgaagctgacggagaaacggacaccggctatcaaaaggtcggtgccgtcagtctccatacggatgaaaaaaagctcagccaaatggaggaaagagcttataaaagaagagaggacgctcctgaaatcggtgacattacgagactgactccggcagaaacgaaggcgctgttccccgcgctgtcggaggaatacggggcggttcatgtcagcggcgcggcccgggtgaacgggagggcgcttcgtaaggcgctgttaaacgcggccgttaatcacggcgcggctgtttacaatgaagaagcgtcaatattgacagaggacggtgccgttatcggtgtgaaaaccgcagaacgcacgcttactgccggccaggttctcgtaacggccggcgcttgggcgagagagctgcttgaaccgctcggcatccgtttttcagtatcataccaaaaggcacagatcgttcatttagagcttcagggagaggatacgggcggctggcccgtcgtcatgcccccaaacgatcaatacattctcgcctttgacagcggcagaatcatagcgggcgcgactcatgaaaacgataccggcatggatttgcgggtgacggccggcggcctccgcgagatttttgacaaagcattaactgtggcgccggggctttcagacagtactgtgatagagacaagagtcggtttcaggccgtttactcccggttttcttcccgtcatcggcaaagtgccgaatatcagcggactcctcgttgccaacgggctgggcgcctcagggctgacgagcgggccgtatctgggggcggaactggcgaaactcgcactcggccagcagacggaaattgatttgagcctttatgatccggccggggcgcttgaataaaaaatagcttttggcgcattcttatgataggatggagctttaatgaataagaggacgtgacccattttgataaaaataaaccttcctgctcctgatgtaacgattacggaacggcagcagtcaccgtcggaaaatgaaccggcgattaaagcgatttacggtttcattgattttcaccgcattccgagagacaaaggcggcatctttatgttttataacattcatgatgaactgctgtttgtcgggaaagcccgtaaattaagacaaagaatcaaaaagcattttgaagacaatgtgtcgcctgttaaacatcacagggacgaagtgtataaaattgaagtatgtgtcgtcaatgatccgatggaaagggagatttacgaaacgtacgcgatcaatacccttcagtcgaaatacaacattgagaaagtattttataaataagaaaaaccggagcttaagggctccggttttctttatgtttacagtgccagccacatcactgcaatatgcacgatcagcagacagtaaacgacgaggaacagctgaacgaccttttttctgaataacatgcagatcatcatgagcacaggaaaaatcaggacgccggccgttttattgattgatgtattcggacggttcgacacgtcatagtgaatggccatatcagcaggaagaaacggataaaacacaatcgacagaataaaggcgagaaccacagctccccacagcaccttatcattcatcaaaaacatatgaacactcccttttttacctataatagtattttagtgtgaaaaagttcatttttcagtatttatttgatggctgtgtgctgtatgggtatttttaaacgcggcggccgccattgagacgatcgctcttgcggtagcggccatcattttgacagtagcaagcgttgacgaagattccgatttaggaaaagagcagctcatcgctaatgtcgttgaccgcattaacgcacagcactgaggatgaagaaagaaaacgctaaggagacgagccttagcgtttttttgattgaagcatctgttttaaatatgcttctgaatcaaagccgagttcctcgtcggcttcttttttcagttcaagctgaagtcgcacatacgtgtcatatttcgggctgagcttttgaagtagattgctgaaaggcgatccttccttcagcgcgggcagatcagaagcggattctccgatcttgatcaggctttctctgtactcttcatctgtctccactcttttcacaagctgaatgatgatgtttttatgagtgtcccaagtggcggggtctctctccaaaatccgctcgataaattggtcatgctggactttgtgctgttggagctgagccgggtcctccttaccgaccagctgcatcatcgggtgtgcagccggaacttcttccatatcatccaatactttaataagctttgcccatatcgtttttttctcatctgtatcaatagaaaagtcgaggaacggttcaaacagcgcggcgataaattctccgaaatctcccgggaacagttttttcagctgaagtcccatatacttcggttcatctattttgacctcgccgatatcatgcagaattgaatcgacattttccgcatcttccacgcgcttgatcagcatttcagtcagtttccgttcctgctcaagctcttcaatctgccggctgagcttttgatgctgctggcgcagtatatcatgcagactgctgccctctaagaggaacgctttaatatcgcttacagacagtgccagcattcggagggcggcaatcattttcagcgtattcacgttctgagcggaatactcacggtatccgttatcagggtttttgctgacggtgattaaaccttcctgctcataatatttgatggcttttttcgtgagacccgtctgcctggcggcttcttttatattcattctgaatcactccctgcttttcattctaaacgtgtctctaagggtcaggtcaagaaagggcgggaaattagacgggtttattctatattttagaaatttcagaaaatatgattgacaacgcacctttgttgcgattaatataacgttatataatgttatataacattatataataaaacactgaggagtgaaggatttgagtcaaactgccgcacaagtgaatcacaaggttcaggctttcttggatgatctgaaaggaaaaacgattgaccacgtctttttcgtcgcttgcgggggttcttcagccattatgtatccgagcaagtacgtgtttgacagagaggcgaaagccatcagctctgatctctacagttcaaatgaatttattcagcgcaatcccattcagctcggagagaactctctggtgattttatgttctcagtcaggcaatacgccggaaacggtgaaagccgccggtttcgccagaaaaaaaggcgcgcttacgattgcaatgacctttgagcctgattcgccgttagcgaaagaagccgaatatgtcgcggtgtatgactggggtgagaacgcacaggcgataaatacgaattacggggttctgtatcaaatcgtgttcggcgctttacacgtgctggaaaaccatcccgcgtttgagcaggcgatcgacggactcaataaactccagaccgtatatgacaaagcgcttaaacaagaagcggatcacgcaaaggcattcgcgaaagcccacgaaaaagaagatatcatttacacgatggcaagcggtgcgaactacggcgtcgcttactcctacagcatctgcattctcatggaaatgcaatggattcattctcacgccattcatgccggagaatattttcacggaccgttcgaaatcattgatgaatctgttccatttattatcctgctcggcttagacgaaacaagaccccttgaagagcgggcgctttccttctcaaaaagatacggcaaaaaactgactgtgcttgatgcggcagcatatgatttttccggaattgacgattctgtaaaaggctacctggctcctctcgtattaaaccgggtgctcagaagctatgcggatgcgctggcggaagcaaggaaccatccgttaagccagcggcgttacatgtggaaagtcgaatattaagaacgcgcattatatttcaccggactataatgatatataacgttatagtccggtgacaaaggaggaaaagcatctgaaaaagctcatctgcctgttcgttctgttagctgtatgtctgtcagccgccgcctgttcaagccaaagcagttcctctgacggaaaagtgaccctgaagttttttcacaggtggccgaaggagccggaaaaaagctattttgaagaagcggtcaaagattttgaagccgctcatccggatattcatatccaaacggaagcggtcttaaacgattcttataaagacaaggtgaaagtcatgctcggaacaacgagccccctgatattttcttttcatggagcgaccggtttgcttataaattcatcaaaggagataaagccctcgatctgtcgtcttactatcagcaggataaagattggtcctcacagcttgtgcagtcacaaatcaaaccctttacgcatgacggaaaacagtacggtgttccgtggcaaatggacgctaaatcattcttttataataaagacatttttaatacattacatttgaagcccccggcgacatgggatgaactgatcacagtctgtgagaaattgaaagagaacggatatattccgatcagtttcggcacaaaagcgccttggaccatttctcattatatcgggacgctgaaccagcgtatggtggatgaaaaaacgcgggcgaaggattacagcccggaaaccggggagtttacggacgaaggctatgtcaaagcgcttgaaaagcttcaggaacttctgccgtactttacaaagcacgtgaactccgttgatcacgaatacgtgcgccagcagtttacgagcggcaaagcggcgatgatttatgcggaaacggcagaaattaagctcgtcgaaccggtcaatctgggcttgtttcctttcccgaaaatcagcggcgaaaagggatctccccgtgcactgaccggatctcccgaaggatttatgatttcctcaaaaacgaagcacccgaaagaagccatggaatttcttcagtttttaacctcgaaaaaaatgggagagaagctgataaaagacgtcggtaaatacagcgcggttcagggaacggcgacagaaaacaattccaccccgatccagcgcgaagccgtgcaggatatcgtccgcgccgaaacaatggtgccgtggtttgatatggatgttgacgttgaaatcgccgatgtgtatgcggcaggcgttcagcagatgctcggcggcacaatgacaccgcgcgaggtgatgaattccgtgcagaaagcggcgcgtcaggtcaaagcgtcatctgaatagaacagatttctttggagaaaggagatgaggatttctttggtcagccgaaagcgtttcattccgtatctgtttctcgcgcccgcgctggtttttctgctgttcgtttacattccgattattgagaatgtgtttttcagtctgtttgaatggagctcatttcaacccgaaaagacgtttatcggtttgaaaaattatattgacctgttccacgatcccgtgttttttacagcactccgcaacaatgtgctgtatgcggtcatatcgctgatttgccaggttggcggcgggttaattctggcggccgtgctggaagacagattggtaagaaaatggtcgccgtttttccgtacggtattttttcttccggtcgtcatttccatgaccgtcattgcgctgttgtttgattttatttataacccggaaatcgggcttttgaatcagctgctggaagccgtcggacttgatgaactgacccgggcgtggctgggcgatgaaaacaccgctatgctgtctgtcatttttgtgtctcaatggcagtctgtcggttacatcgccatgctgtacattgtctcgattcagagcattcccgctgaattatatgaatcggcgcagctggacggagccggaaaaatccagcagttttttcacattacggtgccgcagacgaaagaaatgtcgtttgttgccgtggtgatgacgctgaccggcgcatttaccgtatttaatgaaccgtatattctgaccggcggagggccgggcaatgcttcagaagtgctgagcacatttttgtataagagcgcttttacaaaggatatgatgggctacgcttctgcgatcgcgacggtggtgcttttgctgacgcttgctctgtcgcttattcagatgaaattctttaagaccggaaaggaggagtaggccgatgcttcctgaaaagacggacttgcgtcatgcccgtcaggccgtcagaacaggcggaaaaccgagaaaatggtatgtcggggaaacgtctgtgtggctgtttctctttatctacctcattgccgttgcttatccgctgttatggatggcggtcagcgcctttaaaagctcggatgagatttttgagcacagctggtcgctgccctctgtctggcatcccgaaaacttcgtatccgcatggaaccaagggatttccgcttattttatgaacagcgtcattgtgaccgtgctgacttgtctcatcaccgtatttgtgagtgcctgggcggcatacgggctggcccgttttcaatttaaaggaaaagggtttgtgctgatcatttgtcttggcggcttgatgctgacgccgcaggtcagtcttgtgccgctgtactccattatccagtcattgggactgtacaatacgtattgggcattgattcttccgtacgcagcctatcgtattccgtttaccgtgattctgatccgttcctattttttgtcgatttccaaagagcttgaggaagcggcctatctggatggatgtacaagtttcggaatatttttcagaatattcttacctatgagcgtgccgattctggtgacatcaggcattttgacggcttaccatacatggaatgagtttatgtttgcgattatttttatcgatgatgaaaatttacggacgattccggccgggctgatgcagttcagagatgcgctgcagacggattggggcgtgctgctggccgggctgacgatttctgctgctcctattatcgcgctgtttttattaatgcagagatattttatccgcggcattgcagcgggaagcgtgaaaggataagggggatgaaaagatgaaactgatagcggccggagataatgtagtagattattatcaggatcaggagacgttttacccgggcggaaatgcgttaaatgtagccgtgcttgcccggcgcttaggccacgaaacttcttatatcgggattctcggcagtgatgaagcggcggatcacgtattgaatgtgctgaaactggagaaggtgaatgccgatctgatccgccgggcatacggagaaaacgggatggcggtcgtcacgcttgatgaaagaggggacaggatatttgccggatcaaataaaggcggcgtgcaatcgcgtctgacgctcgcttttcaggagaatgacatctcatttatcgccggacatgatctgctgcatacgagcgtatacagcaggatagaacgtgaccttccgatgctgagcggccatgtgccgatttcctttgatttctctgtaaaacgtgacgaagcctatttagaagcggtctgtccgtatgtgacgtatgcgtttttttccgggagtgatttgagtgaaagtgaatgtgtgcggcttgccgaaaaagcccgcggtttcggagcgaaaatcgtttgtctgacaaggggagaacatggcgcggtgttatcggatggggaacgcgtctatcatcagccggtggtaagagctgatataatagatacattgggggcgggtgattcttttatcgccgggtttcttaccgatttcttcgaacatcaggatattcggcgagcgcttactgcggccgccgggacggctgccaaaacatgcgggggttcggagcgttcggttacgggcatccctacaggccggacggcgggaaaagcagtgaaaaaacgagaatacgataagcattgtctcgttttttatacttgttacgcataggggctgttaatggtaaacgtgacgcggtcggtatgcattaaaaacagcgaactgtatatcggctgttcttttgacataaaagcggttttgtcaatttcaaaaagcgcatccccgatatcacaagccagatagcggctttcttcctgcttggcgtatacgacatttaacagtttcgtattatgggtgggcaccacctgatagtgctgtttcaaaatgtcatgcatcgacacgccgcctttaatatgcttgccgatgtcgggaaataaactgagcggatagtgggcgatttcgaatgagagcggctggtcgtcgtgaaataaaatgcgttttaattcaagaacgggactttcggaagcgacgcgaagtttttgagcgatggatttaggcgcttcaatgatttcatgggaaaggatctggtgtttcggtttttttcccgttgattccataaattcagagtagccgttgaccgcgatgagctcccgcttcagtttagggcttttaacgaacgttccctttccctgctgccggacgagccagccttcttccacaagatcaaggatggccttcctgactgttatgcggctgacgttgtacgtttcgcacagctcattttcagtcggcagttttacggacggcgaataaacgcccttcttgatatcgtccgcgataatttgtttcagctgaatatataaaggtttcgagctcccgttatttaacaatgggacggacctcctttgtcaagtagtagtactattatatgtattatgatgttataatacaaatttgcctttcatttatgaatctgtcagaaaccccgaacatttttaacataacagaaagatgtggcggtttccagtattggaggaggtttcgaatggcatcattaacatttgaccatatcaaaaaaacatacggcgcccaatcggcggcagtgaaggattttcacttagatgtaaaggatgaggagctgctggtgcttgtcggtccctccggctgcggcaaatctacgacactcagaatgattgccggactggagagcatttctgaagggaagctttatatcgatggagacgcggtgaacgatctgcccccgaaggatcgtgatatcgcaatggtttttcagaattacgcgctgtatccccacatgacggtgtttgataatatggcgttcggtttgaagctcagaaagctgccgaaaaaagaaatcgcagagcgagtccggacggccgctgatattttggaaatcgggcatctgctcaagcggaaaccgaaggctctttcaggcggacagcggcagcgggttgcgctcggccggtcgatcgtgcgggagccgaaagtgtttctgatggacgagccgctttccaacttagatgcgaaactgcgtgtgacgatgcgcgccgaaatcagcaagctccatcagcgtttgaaagcgaccatcgtttatgtgacgcatgatcagacggaagcgatgacaatgggtgaccggattgtcgtcatgaatgaaggaaatattcagcaggccgcaagcccccatgagatttatcattatccggcgaatatgtttgtggcgggttttatcggttctccgagtatgaattttataaaaggcgtcatagaagaaagtcacgggcaatggtattttgccggttcgtccgttcgtctgcccattccgaaagaaaaagcggccgttcttgtgcagaaaggatacagcggtcaggagatgactgcggggctgcgtccggagcatttgacgcttgccggacaatcagagcacccgcctgaagcggtgtgccgcgctgtggcggaagtatgtgagaacttaggcgcggagatgtacgttcatgcggtgagcggagatgaccgcatgacgatccgccttgacggcgcttcagaggtgaaacccggcgatgccattctgcttgcggtcaatatgaaccgggccgtgttttttgatgccgacactgaaaacgccgtatattgaaaaagggagcctgatgatggggctcccttatcacttcttatgatacgattaccagatttcgtccgcccattccgggtggtcgataaacggattgcggttatgctgatagtcttcgtaaatgatttcgttccgccgtttttccttactgtcgacggggtcttgtttattccatttgagcaaaacggacagttttcccatgtaaggagctgagccgtttccggttttatcattcagctcaaggtcgggatacccgtcgccgccttcataacgcaccgccatgtaaaacagcatgcgggcgacgtctcctttgacctcatcgcgcggctcccaggaatcaccgtcataataattgcccggcgctttcgggtattctgagccgccgttatcaaaatccatgtttcctctggcgctgttcacctggacgtctgcagggcgcagatgatgaatgtccgtcccggggccggcagctgttccgaagtttccgtgtgactttgcccacacgtgttcacggttccagtccccgacgctgccgccgtttttacttttggcccgtgattcctgggtgtagagcaagatgacattgttcgggtttgccggatcttcgtcagtttccttcaatgcattccatacttggctgtaagacagctttgtatgtccgctgatgatgcggtgcagggcgctctttaaggctgttccgctttttccggaagcttctttgtaatatgtctccgtatccgcagacggagtgatgacagctgaggaagtttgcggaaaaagagttgtgccgccggcagttgaaaccgccagccggctgtacagattcgtgtcagccggcgcgcccgcagaggctgacggcgcggtccaacccaaaatgaaaaacaggcagacaatcggcagaaaccaaagtttttttgtcatgacttgccctcctttacctctattatccaaaaaataaatctaatattctatcttttttgaaaaatggttccttcggcttatgggacagaggggcggtttcttggtcaaagtatccggaaaatcattgattttttggaagatatgataatgaactcgttatgcgctccttctataatgaagatcatcttgtcagtttttcagtttaaaaggagggcatatatggaacatcagcagctttcggcggcgaatatcgggatttccgatgacatacaatggctgtctcaattcggcgcttccgcttccggcggagtgacgaggcttttatatacgaaagaatggatggacgcccagcttgccgtcaaaaagaaaatggaggcgttcgggctggaaacggcatttgacgatgtcggtaacgtgttcggccgtctgagcggcacagaatcgcctgatgaggtgattctgaccgggtcgcatattgacaccgttattgacggcggcaaatatgacggtgcgttcggcgtgctggcgggcatgctggcgatccggcatttgcatgagacgtgcgggcgtccgaaaaaaacgctggaggctgtgtcgctctgtgaagaggaagggagccgttttcccatcacctattggggctcaggcaatatcaccggtgctttctcgctttcagatgcggaaacgccgaaagacgcgtccggcatttctctgaaagaagccatgcggcagaacggcttcggtgcaggccgttatccggcgccgctgcgcactgatattagtgcctttctggaaattcatatagaacaggggcaaacgcttgaacgatcgggaaaggatatcgggattgtcaccgggattgccggacagagacgctataccgttacgcttgacggtgaatgcaaccatgcggggaccacttcaatgaaatggcggaaagatccgctcgcggcgggaagcagcatcatccatgaactcatgctctcagcggaaagacagccggaagagctccgcctgacgtgcgggaaaatgacggttgagccgaatatggcgaatgtcattccgggccgtatccagttttccgttgatattcgccaccagcaggaagacgtgctggcagccttccatcagaaactggtgtcgattattgaaaacatcagccgcagcaaaggagtcagaccctttattgatgaatatatgaggatagagccggttcaaatggatcacatactgacacgaaccgcagcacaggctgcaaaagagcagggggcggacccggagaagatcgtaagcggagcgggacatgacgcccagatgctcggcagaacctttccggcctgcatgctttttgtgccgagccgtggcgggatcagccactcgccgcttgaattcacacccgcacatcagcttgaaaccggcgtccttacgctggcgaatgtattacataaacttgcttattaacgtaaagggggaatcggcgtgccgaccagaaaagaattgtgcattccgcaaagaacgataatgacaccgggaccgacagaagctgaaccgagagtgctgagggcgatgggcgctccgatcctcggccagtttgacccggcatttaccggtatcatgaacgaaacgatgcaaatgctccgtgaattgtttcaaacggaaaaccgctgggcctatccgattgacggcacatcaagagcggggattgaggctgttctcgcaagtgtgatagaacctggcgacagcgtgctcgttccgatatacggacgcttcggacacctgctgactgaaatcgccgagcggtacggagcggacgttcatacgatcgagtgtgaatggggaacggtcttccggcctgaagagattatcggcgagatgaaaaagatttccccgaaaatcgtcgctatggtgcacggagaaacatcaacggggcggattcatccgctgaaagaaatcggggaagcgtgccgcgcccaagatgcactctttatcgtggatgccgtggccacgattggcggatgcgccgtaaaaacggatgaatggaagattgacgcagtcatcgggggaacgcaaaaatgcctatcggtcccttccggaatggcgccgattacttataatgaccggacggccgctgtcattgccgcgcgtaaaaaggtagaacggggcattgcgacagcagctgacggtaaaatgctgtccggtcatcggccggttacgagcaactattttgatctgagccagctcgaagattattggagtgaaagaaggctgaatcaccatacagaagcgacagcaatgctttatgcgctgcgggagggtgtgcgccttgttctggaagaaggacttgaagaacggttccgcaggcatcagcgccatgaaaaagcgcttacggcgggacttgcagcaatgggccttgatttattcggcgatccggaggcgaagctgcctgtcgtcacatgtgtgaagattccgccggaagcagacggcgaatcgataaggagtatgcttttgtctcaattcggaattgaaatcgccagttcgttcggtccgctgcaggggaaaatttggagaatcggaacgatgggctacagctgcagaaaggaaaatgtgctgtttgtgctggccggacttgaagcggttctgatcagacacggagttgcagttaaagccggggaagcgctgcaggcggcccttaacatatatgatctgccggctgaaaccggtatgctgtcatgagatatgaaaacgagattgaaatcatctggacttttttcccttttccccgttatactgaatggtataaaaaatgacaaatatggaatgatcatctgtttgtctggggagaaggtaagaaatcatggcgtacatggggcgattgtcaattttaatgctgaatatgtttattgcgatgcttgggatcggattgattattccgattatgcccgcatatattaccgaattcggagcgacggggagcacgatgggtctgcttgttgcggcggcggggcttacacagcttttatttgcgcctattgccggggaaataaccgacaaatacggacggcggaaactgattattttcggcattgccgcctttgccgtgtcacaattgatcttcgcctttgccggaagcctgtggcaattgttcgcatcccgccttttgggcggaatgggcgcggcgtttttaatgccgtcaatgttcgcttacattgcggatattacgaccgaggaagaacgcgggaaaggaatggggctgttcagcgcggcgatgacgctcggtgtcgtcatcgggcccggtgtcggcggttatttggttcattacggcatgtctgtgccgttcatcgtgtccgcaagtctcgcctgcttttcaacggtgctttcatttttctttctgcccgaaacgctggggcgtgaaaagcagctggaagcccgggcaaaaacggaaaaacgtgagcatctgtttaagcaaatgtcacgcgcgctcaaatcgccgttcgcgtttatgctgattctggtttttgtgctgaacttcggaattatgaactttgaatccgttttcggcctttacgttgaccataaacacggatttaaagcctctgatattgcctttattattacggctgcgggtctcatcggcgtatttgtgcaggcggtcggcgtcagttatctcgtccgcaggttcggggaaaagcgcgtcattaacgtgacgttgatcggggctgctgcaggacttgtgtggtgccggtttgcgggttcatattgggccgtttttgccgcggcaatctttttcctgacgctgacatcgctgctccggccggccgttaatacgatgctgtcgaagctcgccggtgaccagcaggggtttgccggcgggatgaacacctcattcatcagcttagcgaatatcgccgggccgtcggccgccggttttctctttgatgtaaatatggaatttccgtatatgctgggagcggccattctcgccatcagttttctggccgcgcttggctggggcaaaaagacacagacccggccgttcacgcagcaaggataagaatcaaaagcctccgggtatccggaggctttttgctgattgtcgtttattctgcggctgtctgcatctctgaaattgcagagatgcgcatagagggaaaatcatatagcaaaaacagttgttccgtatgctcaagcatggcgcgaatggaaaccggaacaggtgtagataaagtaaaaccagctttatcgcttgacgagtctgatgaatttgatctgccggaagttgatcaaaaaagaaggcagtcaggcaggcagggacaacattgagcggcgtaaatgctgagaaggaaaaagcagggttttggaacttgctgtttcgtatgcagggggagagcattctgataaaacgggtcattgaaataatacgaactgttcagtagggggcgattggtgacaacaaggagaggttatcttataaaacctctcccggaagatgttgtgatggttctcctgcatgaattttgcagattaaaacccgcaattaggccaacacacaattatgcaagagacaatcatctaaaaaggatgtcggtaagtacaatatggtgtacggaaaaggagttgaaaatgttgtattattacccgtcattccatttgtatcagcggcaagaatttaattattatccatgggcccatcaattgactcattcagggggctccccctatgtttccgcgcgccctcctttttataattccccatgttacagagagtgcataagaagcggagcggatagttatttctgctgctatatctgcggtttctgttaaaaagaaagacttatagaagtaagtgatctttccaggatgacagtgagaccattatccagacagccattagccaacacacgaagctttattacggttcacggaggggaagcgcccctcctttttcagaaattttataaaatccccttgcgcggcctgtcagaagcggtttttggtcttgatgtgttcgactgttggtgttgacgaagaattcaagataccaggaagcagcgaaacctgtatgtatccgcgagacacaaagctttccgccgctgagcgggttcattgtcactgcgttctgtctcctgtagtagataacgagattttggggctgtcagttgaggaaaaataaaaaattcaaaacgtcgcaatcgtttaattaaaaagaagagatagaatctatctcttcggattattactgaactacaaaatggtatcgggttttccaagtggaggaatcatcatagaattcaatccaggcttctcctttagcgactgcaaatacctgaatggttttgtagtcagtacctaaagctctccatgtcacagcaggagggttataacccgtaggattaaaggaaatgcgattaccagaagtagaataattccttatctctcctacttttaaattgacgcgggtttcagactgagattgaaacaaattcttattcactttagtagagggaccggcggctgatgctgaagagttaaaaaaaggcgcgaaaacgaatgaaacaattgcaagtgataacaaagcatttttagctagtttcaacgtaaaacctccttttggtatttataggataacagtaacacttaatggaaatataacaatgaagaaattgttaaatattctttgaaatgagtgaacacatgccaagtgaattgataaatgcaaacatcatacatgtttcttacgtagataaggctgctaatcaaaagcggtttttttatgaaatcagaaaaggaaaagcagcatgactttcagggcggcgtggggaagtggttgagtcttgtgtcgctccccgctgattttcaaatgaatggcgaaaccatcaaaaaagggtcatgggtgcttgtgacaaaggttccgaggcagtttaggatgaaatcaaaaagggtgagattatcggttgcatcctgaatatcgaaaaagcctgatgatatcaatggcagcattttttgagggtttagctgaatgaatccccttaaataggatgcgggagaacacccgcatcctggtctatggctaaattttaaccgatcagccgctgcattctcagcgcgagccgcaggcgcatcgtcgtctccggatcttttaagcttttgccgagcagttcctcgcatttttctaaacgatagatcaccgtatttcgatggacgtacaggcgcttagccgtttctgaaatctggcagtgggtttccaggtaaacagacagtgtatgaagcaggctctggtcctccttttgccggtcggccaggctttggagggtggcttcgtaaaactttttcacatcttccgccggaagcaggccgagcaactccggcacgtctttggcatgatagatttgaataaactccgcgcttctggacaaatgcccggatgaaatggcgtctgaagcttcagtaaaagcgtcagggacatcgatcagcttttggcatatgtttgagatgccgaaggagacagtccgtttaaactgcgtccggacctgtttctgaaactgctccaaaaagctgatgacagacgcgtgcatttcattccagctgtctgtcgcttcaattaaaagaataccgacatttcctttaataaagagatgagggggaaacggaaaggatgacagctccccttcaagcagatcaaatacatgatcggaaacgagctgattttcggtaaagctgatcgttttctcatttcggtcgagttttccgcaaatgcacatgtatttctgatcccagcggagccggaattctttggcacggcttttgatttcttcatggccggtaaacgagcggtcgatgaaattgctgaaaaattcattgcgcgcccgtctgccgaattgtttgacggcattttctttcagcagttcaaaggaaatgacgttggccgcctgttcaattgtcaaaatcatgcctttatcagcggtctgcaccagctccggaatcaccagataaccgcagtttttttcaacattcagaatcggcaggacagaatacacctttctgtcggagagcatggaaaagcaggtgaaataaggaccggaaagggaataacagatgtttttcaataaagacgtgtcaatgggtatgctgtgggacgatgataagagttttgtatgctgatccaaaagcagcacgggaagccggagaatgtctgagagcttcttaagcagggattgcagccctttgccgctcatgatgtggtttgtaaattttttatgggcgtaaatggcctgctgcagctcatttgaacgcatatcaagaatatggctcaatgtagcattgacgatatctcccagcctgatgtcttccggcagctcaataatcggaaattcataccggtcggcaagctctgcggcatctttcggaatgacattaagatagcgcttcgttttgatccccagtcccgcgcatccccgttttgccatgaggcggattaaatctttcaacagctgcgggcggtccttcaagtggtaagccgtcgtgacgagcaattcgtttttatgtaaaaaatcagcgatgtccggcgcatccatcatgttgacgtgctgcacctccctccagccgccggatctgcctgcgattaatgcggcccgctcataagcgggaatcttcatcacatcataaatattcatcagtcaatctcctttcaggttctaaagacaaccattggttaatatgaataaaagtcatcaaaaattatagcggttttgctgatgtattacgatcatagtagcagtaaactggcaatcatagacgcatgttgtgataaaaactgacagaaaatcgtcatccttacagggaggaagataaaatggcctatgacgtaattgtaaagggtgcgaaagctgtgcgaaaaggcgggacagagcgggccgatatcgccgtcaaggacgggaaaattgcattgatcgagcccggcattgacgaaaacgcggaacaagtggtgcaggcagacggcatgtatgtgtttccgggcgcggtcgattgtcacgtgcatttcaatgaacccggacgcgaagaatgggaaggcattgaaaccggctcaaacatgcttgctgccggcggctgtacggcttattttgacatgccgcttaactgcattccttcgacggtaactgctgaaaacctgctggcaaaggcggaaatcgccgaacggaagtcagcggttgattttgcgctttggggcggtttgatgcccgggtataccgaacatatccggccgatggcagaagcgggggcaatcgggtttaaagcgtttctgtctaaatcgggaacggatgaatttcaatcagccgatgaacggactcttttaaagggaatgaaggaaatcgcggcgtgcggcaggattttggccctgcacgcagaaagcgacgccctcacccgattccttgaagccgagtacgcgctccaagggaaaattgatgcccgcgcttacgcttcctcccgtccggaagaagccgaatgcgaggctgtgcagcgggcgattgaatatgcaagagcgacgggatgcgcgcttcattttgtacatatcagcacgaaacgggccgtgctctccattcagcaggcgaaaaaagacggattggatgtcaccgttgaaacgtgtccgcactacttattattcagctttgaagacttcctcaaaaaaggggcggctgccaaatgcgctccgccgctccgctcagaggctgataaagaggaattgatcggggttttggctgaagacctgattgatatggtgtcttcggatcattctccctgtcatccggctttgaaacgcgaggataatatgttcctgtcgtggggcgggatcagcggaggccaatttacgcttctcggcatgattcaattagcgatcgatcatgggattccgtttgaacatgtggcccgatggacggccgaagcacctgccaagcgtttcggtttaacgaataaaggccggcttgaagaaggatttgacgctgattttgccattgtccggccggaaccttttaccgtcacaaaagaaacgatgttttccaaacataagcaaagcctgtatgaaggccgcacctttccataccgaattgctgcgacctacagcaaggggtgctgtgtgtatcaggatggcggtcgtaagcagagcgggtctttcggaacattcctgaagccttgtgaaataaaaaagccgattctctgatgagaatcggctttttttgtcgtttggaaagcgggtctcgtggtatctttttataaaaaggagtaaaacacattgtatgatcaaatcttgaacatattaacggcatcctggtcgcgcaagaccagtacaaaatggacggaagattgcccggccacaggccagtgcggcgtgacggctttagtcatccaagatgtttacggcggtgacattctcaaaacaaaaaccggcacaagctggcatttttataatcgaatagacggggagatatatgatttcacgagcggtcagttttcagagccgatcgtctatcagcatattctttcttccagagatgaggcattttcggacaccaatgaacatcagtaccgttacctgcaaagtgcattcagaaaaaacatggaaacggaaagagaaaaacacctgtgataaactagaatgagaggtgaaggattgtgatttatatcggactgacggggtggggggatcatgacagcatctatccgcctaaaacagcgggcccgcaaaaactgcaggcgtattcctcccattttcccatcgttgagctggacgcgagcttttacgcgatacagcccgcccgcaataacgaaagatgggtcaaagagacgccggaatcttttcaatttgtcattaaggcatttcaaggaatgacgggccatcagcgcggtgatattccctttgaatcgaaggaagaaatgtttgaggcgtttaagctgtcattatcgccgtatatagagcatggaaagcttgccatggtgctgttccaattcccgccgtggtttgactgcaagaaagaaaacgtcgcatatttaagatggtgcaggaagcagatgggcgatatcccgtgcgcgcttgaattccgcaaccgatcttggttttccccgccattttacgaacagacgctttcctttatgaaggaggaaggctggattcacagcatatgtgacgagccgcaaatcggcgagggcagcattccgaccgtcctgaaagcaacggatgaagaaaaaacgcttgtccgttttcatggacggaacaagcagggctggatcaaacctgacggcggacaaaactggcgtgaggtcagatatttataccgctataacaaacaggagctcaaagattggaaaaacaatcttcaggagctgaaaaagcagtcgcgcaatctgtatgtgctcttcaacaataactcaggcggagacgccgccgataacgggcttgagatgcttgaaatgttagatatctcatataccgggcttgctccgaagcagctcgacctattcagctagaaaagaggtttcaagacacatgtcttatcttattttgattatattgggatttatcgcgggaacggtcggcagcctgatcgggcttgggggaggaattatcatcgtgccggcgatgctctatttaagcacgatgaccccgtttttccatgacgtaacaccgcagactgccatcggcacgtcccttttggtgattatttttacgggcctgtcatcaactctggcctatatgaaatataaaaccgttgactacaaaagcggactgatcttttttatcggttccggcccgggaagcatcatcggcgcgtatttgtctaaactttttaatgcgcatacgttttccgtctggttcggactttttatgattttgatttctattacattaatgctgaaggcgaaagcaaaaccggtcaataaagcgcataaaggcatgatccggacatatgaggatgaaacgggtgagctttatacatattcgtaccgtatttttaccggtatcgccattgcctttttcgtcggtttattgggcggtcttttcggcatcggcggcggctctcttatggttccggccatgatgctgttatttttgttcccgccgaaagtggctgtggcgacgtcaatgctcatcattttcttatcctccgtgacgggttccgtgtcacatatcgcagagggccatgtcaattggctgtatgcgctgtgcctcgttccgggcgcgtggttcggcgggaaaatgggcgcgtgggtcaataagcgggtgcagacgaaaacgatcgtgcttttcatgcgggtcgtcttgattttgatcggctgtgaattgatttatcaagggatattcagctaaaaggtaggagagatggtatgttagagaaactccgtttatatcatacgaatgatttgcacagccatttcgaaaattggccgaaaatcgtacattatattgagcagaagagaaaagagcatgaaaaaaacggggaggaaacactcgtattcgacatcggcgatcatatggaccgatttcaaatgataacggaagcgaccttcggcaaagcgaatgtcgacttgttaaaccggcttgagatcaatgcggctgccgtcgggaataatgaaggaattacgctgcctcacgatgagctggcgggtttatatactcatgccgcgtttcccgtcattgtgtccaacctgtttgacgcggacggacagcggccggaatgggccgagccctacgtgatcaaaacgctgaaaaacgggatgaccgccggcatactcggggtcacggtgccgtattatcccgtctatcagaaactcggctggacggtgacggatgcggaaaaaagcattcaagaatcacttgacgatatcaagggcaaagcggacatcatcattctgctttctcatttaggcctgatcgatgaccgggccgcagcggaaaaatttcccgacatcgatgtcattcttgaatcacatacgcaccaccttcttgaggacggacaggatataaacggcgtattgcttgcatgtgcggagaaatacgggaactatgtcggctgtgtcgagctgacgatagaaagtgaatcacgaaccattgtcagcaaacaggcatctgtacagaaaatggctgattggcacggggaatctgaagatacggcggcttttctgaaagagaaagaacgggaagcggaaaacctgctctccgtacaagtcgccaatctgaatgaagaagccggcgtgaagtggtttgaggaatcgccgctcccgcttctattagccgaagcgctgaaaagctggtgcggctgtgaagtcagcatggtgaattcaggcgtcattttggggcctttacagaaggggcctgtcacaaaacttgacttgcaccgcatctgccctcatccgatcaatccggtcgccgttcgtctttcaggcagggaactccgggaaacaatcagccaggccgcctcggaacaaatggagcagctgcggattaaaggcctcggcttccgcggggaagtgatgggcaggatggtatatgccggagcggaggcagaggccggcatccttgaagacggtgtgacgcatctcctcaatgtgaaagtgaacggagaagaggtggatccggagcggatatactcggttgccgttctcgacatgtttacactcggaaagctgttcccttacatccgcgattcaaaagaaaaacaatattttatgccggagtttttaagggatctgctcgcctggaagctcgcgcggcaagcgtaatgtcaaatatccgccggccgttccatctcacccgaatgaaggtaagcgggactttttaagagcaaaaataaaatactatgtcccctcttacaagcatacattgtgatatgtaaggggggatttttcttgcctagataccggagcgctcttcgcaagagagggcctttgccttttcgatatgtgcttcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagcatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcgttctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaagacatcagtcgtcacaaataatattccggtctccattaaagcgattcaaggagaggtgccgcagttttataacggaagcggcggatcaggtgtgacgccttctgtccagctgccgagtgaaaaacagaagaaagataaataaaaacacacagccgcaatctttcctggcggctgtgtgtttactttttcctgcggatttcttttcgctcccatgcccttaaatggggatacgggtcaaaagaccattccgatctgccgttatctttatacatcccgtagtgaagatgcggcggaaattttcccgcggtgcccggcggtccgtatccggaactgccgacagagccgatcacctctccgggtttgacgatctggcctttatgcacaccttttgcaaagccgttcaggtgagcgaagtagtgatacgtgttattgatatccctgatgccgattctccagccgccgaaacggttccagcccttcatttcaacaataccgtagcaggtcgatctgacggggagtccgtaatgagcgaacagatccgttccttcgtgaatccggcgcccgccgaaaccccgtgcggcgccccatgtgctgcggtagctgtaatccgtcttcacgggaagcggaaaagcgtgctctccgagatcaaggcggccgaacgttttaaacagtgtcatgaattcggtgataatgccgaccgtctgatcacggcggtaataattccagaggccgatgcggatatggtcaagatccgttccgaatcccgctaaatactgtgcaaatgtataaaggatatcctcatcattgctgacctcggcttttccgtcgccgtcgccgtccaggccgatcccgtcaaatactttaatgctgaggggcgcctcgtccttaggatttggattttcaggcccgctccacaaatgatccggaatataaatgctgatgattcccgctttttccggcagatcctttcggttcgagcggacattttcttcatattgatcaaccgccgcaagcacataccaaggaatctgcgtgactgcttcggctttgcggtacaactgcatccgttcaccgtaaacaggagccgattgttctttcccgcttgcagccggacagaaaactgataaaaggagaagagcagataacagaactttcacaacatgatctcctttcaggattaatacaactagtttgcggcaacaatccgagaaaatgtaagtaattctcttcccttgtcgagaaatttttcctatgttaaagtgactattgaatagaaatctgcaagttttatatccatcgtgaaatagaaatttttcgcacacgaacatgaataaagggataatggagatgatggggaaatggcaaagaaagacgagcatctgagaaagccggaatggctcaaaataaagctgaacacgaatgaaaactatacgggtctgaaaaaattaatgcgtgaaaataatctgcataccgtatgtgaagaagcaaaatgcccgaacatccatgaatgctgggctgtcagacgtacggcgacgttcatgattctcggttccgtctgtacgagagcatgccgcttctgcgctgtcaaaacgggtctgccgactgagctggatctgcaggaaccggaacgcgtagctgattcggttgcactgatgaacttaaagcacgccgtcatcacggccgtggcgcgtgatgatcagaaagacggcggagcaggcgtctttgcggaaacggtccgggcgatccgcagaaaaagcccgttcacgacaattgaagtgctgccatccgatatgggcggaaattacgacaacctgaaaacattaatggatacccgtcctgatattctgaaccacaacattgaaaccgtccgccgcctgacaccgagagtccgggcccgcgcaacatatgaccgttctttggaattcttgcgccgtgcgaaagaaatgcagcctgacatcccgacgaaatcaagcattatgatcggtctcggcgaaacgaaggaagaaattattgaagtgatggacgacctgcttgcgaacaatgtcgacatcatggcgatcggccaatacctgcagccgtcgaaaaaacatttaaaagtccaaaaatattatcatccggacgaatttgccgaactgaaagaaatcgcgatgcaaaaaggcttcagccactgtgaagcaggcccgcttgtccgttcttcctatcatgcggatgaacaagtgaacgaagcgtctaaaaaacgccaggcccaagcataagataagccgaaaaaacccaaaacgccgcaggttttgggttttttgtgatggagccgtctgtgcagggaaaaagtcattcttgaataaggatcgtcagaaccgctacactggatataaaaggggaaaatttttccgtccgtccgaaccgtctcattttgcaattgatggacagaagtcaatgaattatgatagtaaagagtgataaaagaggtgaagacatgattcttattcaaaatgccgagtttgaactcgtacacgattttaaaaacggctttaatgaagaagcgttcaaagcccgctattcggacatattaaataaatatgattacattgtgggagactggggatacagtcagctgcggctcaaaggcttctttgatgaccagaatcaaaaagcaacctttgaaacgaaaatcagcacattggacgaatacatttacgaatactgcaatttcggctgcgcgtattttgttttaaaacgaatcagaaaataattgatgcagaaggggatgctgtcacgtgtattttgttgacagaaataatatcgaacaaacactccgtttttttgagacccagctggcgctgtttgacagcacgcctgcatggcagagcgaaatcgaaaaaagggcgcttgagcggatcagccatcttatgatcgaatgcattctcgatgtcggaaatgatatgattgacggctttatcatgcgcgatccggggagttatgacgacatcatggatattctgacggatgaaaaggtggtagctgaggatgaagcgaataagctcaagcagctgatctcttccagaaagcggcttgttcaggaatatcagcaagccgatcatcaggagctgtttacgctgatcacgtcaaacagggacgtgctgaaagcctttccggcccgtgtaagaacctacctggaaacagaattagggcctgtttccgcatttaaataacaacgagtgagaaaatccacaggagtgttgagtatgaaggattataaaggatatttgatagatttggacggcacaatgtacaacgggacggaaaaaatcgaagaagcgtgtgaattcgtgagaacgcttaaagcgcgcggcattccgtatttattcgtgacgaacaattcttcccggacgccgaagcaggtggcggacaagctgatgagctttgacattccggcaactgaagagcaggtcttcacgacgagcatggcgactgcgcagcatatcgcccagcagaaaaaagacgcgtcggtgtatgtgatcggcgaagaaggcatccgccaggccattgaagaaaacgggctgagcttcggagaagaaaacgcggactttgtcgttgtgggaatcgaccgcggcattacatatgaaaagttggcaacgggatgccttgcgatcagaaacggcgcccggttcatttcaacaaacggcgacgtcgccattccgactgaaagagggcttttaccagggaacggttcgctcacatccgttttgacggtgtcaacgggcgttgagcctgtctttatcggcaagcctgaatccattattatggaacaggcgatgcgtgtgctcggaacggatatttccgaaacactcatggtcggcgataactatgcaacggatattatggccggcctcaatgcgggcatggatacgctgctggttcataccggagtgacaaagcgtgagcatatggcagattacgaccggaagccgacatatgcgattgactctttaaccgaatggattgaacatctataaaaaagggacggccatgacggccgtccttattctgtatttctggcgctgtgggcaagccggcttgaagccgctgctgcgattgcgccgacgatatcatcaagaaacgtatggcattcccccgtagatttatcatttaaccgcccgagaatgccgggtttttctttgtcaatgtagccgtaattcgtaaagccgattgagccgtatatattcacgatagagaaggcgagcacctcgtcaaccccatacaggctttcatcaatcgccagaatggtctgaagcggttcagacagttttttttgttcggcgagcacatctaattctattcccgttaaaatggcgttttgcacctcgcgttttgcgatgacacggtccacattgagcctgcatacttccatcgtcaaatcaggatgatattttttctgaaggaaatacaccagctcggcaatatcgtccgtctcaaccccccgttcttttaaacgcgctctggcgacagcttccacctgattcagttgttccttttctgacatttgcttcacccaatctttttttactagtttatacaacacccttccgatgtgtacgatgtttctccacttgattcaaaggattacaatatgtattcataattccgccggcgtatgactacgatgtgaatagctctaatttttcaggcaggtgattatgatgaaaagcatcattaaagaaaagtacggcatccacgtcagacagctttccgtttatcagaaataccaatgcttccagacgcctaattccttctttcttattattcccgtttccgggttttcgcaatcagagctgacggagctttactacatgagtcagtatttacaagaacaaagtgacccatacgtttcagtgtttatctttacgaaggaaggagaactgacctttgaggacgaaggcaaaacgtatgcgctcttaaaagcgccgatccccgtcgcaaaccggtcgttctctgtcggaggggagcttgccgaatttcacagaaaagggcggggttttccgtacgaagtgaaagaagcgggcaggatcggccaatggaaggacttatggggaaaacgggtggatcagctggaatcattctggatgcagaaaattcatatgtctccgcttgaaccgttcgaaaagaaaatgatcgaagcatttccttattattcaggcttagcggaaaatgcgattcaatatttagtggatacggagctggatgacaatcccggcgcagaagactcggggacaatctgccatcagcggatggaacgggatacctggtcggaggaatcattgatccgcattccgggcgattgggtattcgaccatgccgcccgtgatattgcggaatatatgcgcagcacatatttgtatcatcgtgacgacttgcttaacgaagggtttttgtttttgcaggaatatgagcaagttacgccgttatcctccttttccaagcgcctgttttacagccgcctgctgtttccgcttcatttctttgagacggtggagagttattacatttctcatgattctgaaaaacagttttacgaagagcagcttgactacattcttgccgactgcacccgctatgaacagtttttacagacatgtcacgacatgatgaatgtcaggtcggcgcaggtttttgtcccgcctgtggcgtggctcggaaaaggaatcagttcgtaagaaaatataacgtaaaaatatttagaaaatagggaatcttgtcatatcaatgtgttaagcgttttcatggccgtagaaacaatattcagccgcttgtcaaaacaaatgcgggcttatataatatttgtaacttaaatgtctgtgaagggttaacaattgtccttttctagtggacaaaaggaagaaaggtggagtttctctttggaagcgattcgtattggactgttaggactgggaaccgtgggaagcggagtcgtcaaaattatacaagatcatcaggataagcttatgcaccaggtcggctgtccggtgacgattaaaaaagtgctggttaaagatattgataaaaaacgagacgcagacctgccgaaagaagtgctgacgacagaagtctatgatgtgatcgatgaccctgaggtcgacgtgattattgaagtcatcggcggtgtcgaacagacgaagcaatatcttcttgatgccttgaaagcgaaaaaacatgttgtgaccgcaaataaagatctgatcgccgtatacgggtcagagcttttagccgccgcaaaggaaaatggctgtgacttgtattatgaagcgagtgtcgccggcggaatcccgattttacgcacgctcgaagaaggcctttcctctgaccggatcacaaaaatgatgggaatcgtcaacggaacgacgaacttcatcttaacgaaaatgattaaagaaaaaagcccgtatgaagaagtgctgaaggaagcgcaggatctcggattcgcggaagcggacccgaccgccgatgtagaaggactcgatgccgcacgcaagatggcgattttagcccgtctcggcttctctatgaacgtcgatctggacgatgtcaaggtaaaaggaatttcccggattacggatgaagacatcagcttcagcaaacggctcggctatacgatgaagctgatcggcatcgcccagcgtgatgacaataaaatcgaagtcagcgttcagccgacactgctcccggatcatcatccgctctctgccgtgcataacgagtttaatgccgtttacgtgtacggagaagccgtaggcgaaacgatgttttacggcccggagccggaagcatgccgactgcgacatcagtcgtttccgatctggtcgcggtcatgaaaaacatgcgtctcggcgtaaacggaaacagctttgtcgccccgcagtttgaaagaaatctgaagcagccgtctgatatctacgcccagcagtttttaagaattcatgtcaaagaccaggtgggctctttttcaaaaatcacatcggccttctcagagcgcggcgtcagctttgaaaaaattctgcagctgccgataaaaggacatgacgatctcgcggaaatcgtcatcgtcacgcatcatacatcggaagaagatttcagtgacattctgcaaaacttaaatgatctagaagttgtacaagaagtaaaaagcacatatcgtgtagaagggaacggttggagctaatgtggaaaggactcatccatcaatataaagaatttctgccggtgacggatcggacgccggccctgacattgcatgaaggcaacacgccgctgattcacctcccgaagctttctgaaaagctcggaattgaactgcatgtgaaaacagaaggcgttaatccgacgggatcttttaaagaccgcggcatggtcatggcggtcgccaaagcgaaagaagaaggcaatgataccatcatgtgcgcctcaacaggcaacacatccgctgcggctgccgcatacgcggcgagagccggcatgaaatgcatcgtcatcatcccggacgggaaaatcgccttcggaaagcttgcgcaggccgtcatgtacggtgcggaaatcatcgcgattgacggaaactttgacgacgcgctggccatcgtccggtcgatttgtgaaaaatcaccgattgcattagtgaattcagtaaacccttaccggattgaagggcaaaaaacagcggcctttgaagtatgcgaacagctcggcgaagcgccggacattctggcgatcccggtaggaaatgccgggaatatcacggcctactggaaagggttcaaagaatatcatgagaaaaacggcaccggacttccgaagatgcgcggttttgaagcggaaggttctgcggctatcgtccgcggcgaagtcattaaaaatccagaaaccgttgcgacggcaatccggatcgggaatcctgccagctgggacaaagccgtgctcgctgcggaagaatcagccggaaaaattgatgaagtcacagatggagaaatccttcacgcttatcagctgattgcccgtgaagaaggcgtatttgccgagccgggctcctgtgcatccatcgccggcgttttgaaacaggtgaaatccggtgaaattccaaaaggaagcaaggttgtcgcagttttgaccggaaacggcctgaaagatccgaatacggctgtggacgtatctgacataaaaccgatcacgctgccgacagatgaggacagtattctggaatacttaaatggagcggcgcgtgtatgaatgaggcggagatgctgttttccattacggttccgggaagcaccgccaacttaggacctgggtttgattccatcggaatggcgctcagcagatatttgaagctttcggttttccgaaacgatgaatggcagttctcggcggaaaccgaaactgtcgcgggcatccctcaaggaacggacaacctcatctaccaagtcgccaaacggacggctgaccgctatcagaaagagctgccgcccgcccatgtcaaagtttggagtgacatcccccttgcgcggggtctcggaagcagcgcggccgctatcgtcgccgccattgagcttgcggatgagttatgcggcctgcagctgtcggaaagcgacaagctgcacttagccagtcttgaagaggggcaccctgataatgccgctgcttcccttgcaggagggcttgtaatcggccttcacgaagaagatgaaacacatatcgtgcgtgttgccgaagcggatatcgatgttgtggcagtgattccgttttacgaagttctgaccagggacgcaagagacgtgctcccgaaagagctgccgtaccgacgcgccgttaaagcaagcgccgtcagcaaccttctcgttgctgcgatcatgtcaaatgactgggcgctcgccgggaaaatgatgagaaaagacatcctccatcagccgtaccgcgccatgcttgttcctgagctttcaaaggtggaacacgcggccgaaatgaaaggcgcttacggaacggcgctgagcggagcgggaccgacgattcttgtcctgattgaaaaaggaaagggagaagagctgagaaaacagctttctgagcatttccctcactgtgagattgcggcgcttaccgtcccgtcagaaggaagcgtaattgaacggaatcctttagagcaggtgaaaagtgtataatgataaaaaagcgttcttcccatcagagaaggacgctttctttttctggagaaggatttttatttagggaagcgaaataaaaaagaaaaggaggagatacgattgaaaaaactcataaccgaggaggacattgcgtcactcgtatccgtgacagacccgcaatatgcccctgacggcagaagagccgcttacgtccggacaacagtcaatcataagcgtgattcctattcctcagccattatggtatatgacacagaatccggcatctcaaacccgtggactttcggggacgataaaaatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatccctcattctatacatacacggcgggcctcacatgatgtacggccatacgtattttcacgaattccaagtgctggccgcacaaggatatgctgtcgtgtatgtcaacccgagaggaagccacggctacggacaggattttgtcaatcgtgtcaggggtgattacggaggcggagattaccgtgatgtcatgcaggcggtggatgaagccgttcaggcgtatccgtttttagacagcggccgtctcggtgtgacgggcggaagctacggagggtttatgacgaattggattgtcggacagacaggccgttttaaagcagccgtcacgcagcgctccatttcaaattggttcagcttccacggtgtcagcgatatcggcttcttttttaccgactggcagctcggacatgatttgtttgaggaagcggataagctttgggatcgttctcctgtaaaatatgcatcccgcgtttcgacgccgcttttgatcctgcacggtgagcgagatgaccgctgtccgatagagcaggcggagcagctctttaccgcgttgaagaaactgaacaaaacgacgtcgttcatccgatttccgaaagctacgcatgagctgtcgagaagcggccatcccgaacagcggatgaaacgcatccgttatatttgttcatggtttgatgactatttgtaaaaataaaaaaaccaggctgtcatgcagcctggttttatgattaaaatacttgttctacttcaacgacacccggtacttcttcaagaagggcgcgttcaattccggctttcagcgtaatcgttgaacttgggcagctgccgcatgcgccaaggaggcgaagctttacaatgccttcgtctacatcaacaagctcacagtcaccgccgtcacgaagcagaaacggacgtaatttatccaatacttcctgtacttgctctttcatttcaacctcagtcatgagattcgctcctttcatatacataaaaccattatattcacagtaacggtaaaaatctaatgtttggtttgcaaagctgctttctccattatagcatatttaaacttgaacataaaaaccgttttttatacaaaagctgccccgtcctttgtatactggtgtaaaggggatgatatacatgacaaagccggttacgctcagtgtttacggcgctgaaacgctttgcgcaagctgcgtgaatatgccgagcgccaaagatacgtttgaatggctggaggcggcgctgaaacggaaatacccggagcagccttttaacatgcggtatattgatattgaggcaccgcctcagcaaaaggagacagaagagcttgcggagcgcatcaagaacgatgaatttttctatccgctcgtgctggtggaggatgtcattgtgggggaagggaatccgcatttaaaagatatatatgaagaaatggaaaagcgcggctatgtggcgggctcttaaaaatggccgctgatcgcaatcagcggcttttttcttatcagccgttatgatgcttgtacatccataaaaggcctgattttaataaacggggcacacgcccgatgagcggacggtcgttgacaagaccgaagcccgctttttttccgagtgaaccgaggacgcctttcagcttaaattgcggcattgtttccggcagctcttcattgttccagcgtttcaggaggatctgcacaatttgttccgcctgcgcttcagccagctgggcgctcggcgcatgcggcaggctcgcgcaatcaccgacgacgtaaacatgctcatcgcccggaagattgtgatgcggtgttaaaacgatgcggccttgcgggtctttttcagcgtccagttctctgacggctttattcggctgaattcccgccgtccacacgatggcatcggccggtattccttcatcatgattataaacgatgccgtcttccacttttgtaatattcgcattattgataatggtgacgccgtgttcttcaaaccatttctgaacgtacttgctgagtcttttcggaaagcttgataaaatcaggtcgccccggtcaaataacataatcttcagatcgtcacggctctctcttaattcactggcaagctccacgccgcttaatcccgctccgacgatagcgacagatgcattggcgccgaggttgttcagcttttgataggcttcgcgtgactgatcaatggtctgaatgctgtaagtatgttccggcgcgccgggcacgttatgatacttatcctcacagcccagtccgatcaccgcgtcatcgtaagaaatcggttcgcggtcatgaaacagaacctgtttgtttttcgtgtcgatggaagccacctcaccgtattgaacatccagattcggatgctcaggaaaagacaccctgatatgatgatcagaaatcgtgccggctgcgagcgcataatattctgtttttaagcagtgatacgggtttctgtcaatcagcgtgatggatacatctgacggaagctggttcggcagtaagcggtgcagcacccgcatgtttccgtaacccccgccgatcaagaccaattttttcataatgattccccttttgcccgaaaaatatggtagtcaatattgttacaaaataacgaactatgtaaaataacatctagaattatatcgaatttgatctaaaaccacaataatagttttaaaataacctacaaattgaccagaaaacacgcaatagtaaaacctttaacctgaattaatatgttacgataacattgagcgtgaaaccggatctttgacgaatagaggaaattccgttaggataaggtacatatgtgaggtgaaaccgcatgaatccgatgattgaattctgtgtcagcaatttagcgcgcggttcccaggaagcacttgagatcttagagaaggatccgaacttggacgtgcttgagtacggctgtttaagctactgcggaaaatgcatggagtccctgttcgccctggttaacggcgaagtggtcacggggggcacgcctgctgagttggttgacaacatatatacattcatagaagaaaatccgatgttttaatcagaggctccgaacggggtctcttttttattgcgcccgggttttggcaaaataaaaaatttgtagacagcaaaaataaatattgttatcttaataaagactttttttaaataaaattttagaggtggattcattgaatatcgtttgggggctgctcggggcagttgctatattagccattgcttttttgttatcagagaagaaaagcaaaattaacctgcgaaccgtcattgtgggtttatgtttacaaatggccttcggattcatcgtattaaagtgggacgccggccgggccgtatttttatggttctcaagccgtgtgcagcttctcattgattatgcgaacgaaggcatcagctttatttttggcccgctgttaaaagtgggcagcagcccggctttcgcgctgagcgttctgccggtcattatctttttctcagcgctgattgccgttttgtatcacttgaaaatcatgcagctcatctttcgcgtcatcggaggcggactgtcaaaacttcttgggacaagcagaacggaatcgcttgcggcggctgcgaatatttttgtcggacagtctgaatcaccgcttgccattaaaccgctgattgcgggattgacccgttccgagctgtttacgattatgacgagcggcctttcggctgtagcgggttcgacgcttttcggttacgccctgttaggcattccgattgaatacctgctggcggccagctttatggcggctcccgccggtctcgtgttcggaaaaatgttaatacctgaaacagaaaaaacgcagacgataaaaggcgattttaatatggacgaagaaggcgaaggcgccgctaatgtgattgatgcagcggcaaaaggcgcatccacgggccttcagattgctctgaatgtcggcgccatgcttcttgcgtttgtcgcgctcatcgccgtagtgaacggaattctcggcggaatcggcggctggttcggtttcaaacatattacattagaatccattctcggttacgtgttttcaccgatcgcatttgtaatcggcgttccttggcatgaggcgctcggagcgggaagctatatcggacagaaacttgtgctgaatgagtttgtcgcttattcaaacttcggtccgcatattgcggacttttctaaaaaaacgtctacgattatcagctttgcgctgtgcggatttgccaacttctcttcgattgcgattatgctcggcacactgggcggtttggccccaagccgccgttcggacattgcgcgcctcggattaagagcggttattgcgggaacactcgcaaaccttctcagcgcggcgattgccggcatgtttatttagtaaacgataaaagctccctgcatatgcagggagcttttatgtatgaaaaacgggggatatttgtattgtgtccgaggggaagagcttttatactaagtaaaagaaaaaaagttggaggccgatatgaattcattccgttttaccaagatgcacggtcttggaaacagttatatatatgtaaatcaatttgaagaacagctgccggaagaacggctggctgagattgccgttaaagtgtccagcattcacacgggcatcggctctgacggaatgatcctcatctgtccgtcagaaaaagcgccggtcaaaatgcggatttttaataatgacggctcagaagggaaaaattgcggcaacggccttcgctgtgtggcaaagtatgcatacgaacataagctgacagaagaaacgtcctttttcattgagacgctttcaggccttgtgaaagcagatattacggaagaaaacgggattgtgcgtgaagtcgccgtcgatatgggcgaaccgcgcctcaccaaaaaagagctgccgatgctcggcaatgaagatgaacggacgatcgatgaaacctttgtttttggagaaacggagctttccggaacagccgtatcaatgggaaacccccatattgtttttccggttgcggatattaatcaagcgcctcttacaacgctcggtcccgtcattgaaaaagacccgagatttccggaaggcgtcaatgtcgaatttgtggaaaccgtcagcgccgatgaacttcatttccgcgtatgggaacgcggctccggcattacacaggcttgcggaacgggcgcctgtgcggcggctgttgcatccgtattgaacggtgtttccgaacgaaaccgggatatcaccgttcatttagcggggggcgatcttgtgattaattggcaggacaacgggcacgtgctgatgacgggacccgccgaaaccgtatgcagcggcgtctattatttgtaaacagctcgtttgagaaatacgctcctcaaggtttataatagatatcagcatccgtttttaaaaaaggaggtctacttatgagtgttccagtaactattactgaagcagcggctttgcatataaaagatatgatgaaagagcatgaagaagaaaacgcgtttctccgtgtgggcgtaaaaggcggcggctgcagcggcctgtcttacggaatgggatttgagcacgaaaaaggcgaaaaagacagcatgtttgaacagcacgggatcaccgttttggttgacagcgaaagccttgatattatgaccggcacgatcattgacttcaaacagtccatgatgggcggcggtttcaccattgacaacccgaatgccatcgcttcctgcggctgcggatcttctttccgcacggccaaaaacgccggtacgccggaagagtgctaagggtcagcccgccattctcaggatgaaaaaataggacgcctttcttttcgatggcgcttgcaccattgttaaaaaaggcgtttatctgtttaataaaagcaaaacccgctcaacagaagcgggttttgctttttcaaagaggttattcaattgtatgtttcatcgcattgtacatatttgccgtatgttcatcggctttatcccgtgacatgcgcagccgttccgctgaagaaccgtaaccgatttctagtttgccctctttcagtcctttaaaaatcccatcagcgaattcatccagcggttctccttgagtatgcagccctgctccgcctaaatctgtatttaccgccggaggcgcaacttcaatcacttctacagatgaatcagaaagctgatgtctcagactcattgtaaatgaatgaagcgccgctttcgttgctgaatagatcggtgcaatagcaagcggtgtaaaagccaatcccgaagagacgttaatgacagccgcatcttcttttccggcaaaaaacggagcgaacagcatagacaggtggaagggagcttcaatgttcgttgtgatttctttattaaaatagtcccaattgtccttcgcatccgctttcagcacatgaaaacgatgttgaatccccgcgttgtttactaacacattcacttccggataattttctttcacccaatcaaacagtgatacacgttcagatggaatgctcaaatcactgacataggtaataagatccgggaatgtttcctttgctttttgaagagcgtgcttacgccgtccggtcacgatgactttatttcccgcttttaaaaaccgttctgcgaaagccaatcctattccggcatttccgcctgtaatcagtattgtatttcccgtcagtttcatattaactcctcttttccgattgtttttacttcaacaaacttacgtctcttgaacagagcttttgatataagcctttgtcattgacgacatttcatccagtactgaccgcttgtgtctcctcatcatgtcaagccggagtttaataggactctctccttcaattacccaatcaatatattgcttaaagcctttgatggtcatgcgggtattttttaaacaaatcacgatatcaaggagcggcatttgatctgctgaaaataaccgccggctggcttcatcacgttcaatcagcggcagcagtccctttttttcataataacgtaacgttgattctgtcatattacactttgctgctgcttcacgaattgaacaacatgtcttcgaaagacctccaacagtattttttccttgtcactgggtgatgatacgacttaaaccatgttttaagtcaataaaaaaaatgtgatgaattcagacatatgtcacaaaaggaaatgggcagattttcaataggtttaggagtgacggccttcacaaaaatcctcaaatcaacggttcaaatcatactatttgcaaattcggaaaaaaataaagggtatatagaatcaaaaaatctggaagatgtgctcttagtcaacacgttctaaagtcatatttttcgaaaggatattgattttttgataggaataaactaaattgtaaaagtatagaatagttaatttattttgtaagaaaaggatgataatatgataggtcaattgagcaataaaaaaatatttttaagttcttttttcatcattttgatctgttcattactcttccaattcagtatttccgataaagttctgcagtcgtattattcttccgtcggagaaagtacctacgatatcggggagaaaagtgttcgtacgattgtcatgtttctgcaagggtttatgatcttcacaacttttgtggaaattctgataggcggatttctattattcgttgccgcttttattctcggtacaaaaaaaccgaaaaaaatatatttgcttctatatacactgacttctttaatctcggcatttaaaatgttgattctttcagttgttaactacttaacggctgattcctcgcttatatattctgccggcggcaccagcttgagtctgcagctgctggatccatttctgctcatatcaattgcggctctttatgctgccgcaggaaaactgaccgatctcagtaaaggcaagagaatcattttgactggatgttttgttttattaaaactctttactattttctttaattattttatggcggataaaatttagctcgggagagagtcaattaagctgaattttattataaattaaaaaaacagagtagggagatgttatgatgaacttagtaaaatctaataaaaagtctttcattttgtttggcgtggctcttgctgcagcaacattggtttatgcactattattaacgggaactgaattaaacgtggcggcggctcatgcattctcagccaatgctgaattagcttcgactctgggcatctctacagcagcagctaaaaaagcaattgatattattgatgcggcatcaacaattgcttctatcatttctctcatcggtatcgttacaggcgcaggcgcgatttcttatgcaatcgttgcaacagcaaaaacaatgattaagaaatacggcaaaaaatacgcagctgcttggtaaaatcgaccaataaataattgctctttttgtacaagctgcaaaaagagcctctctcccaaatacatatgtaaggattgaaagtatgatagtcaaacaaattgcggctcttatcaaatataataccctgtcatcgtttcgaaaaagaaaggaagattggggcattcctcaactcaacagcaaactgctgtctgccattattatttctctgttatgtttatatctcgttttcctgggatgcggtgttgtattcgggacaaaactgattcagctgcccctcagcgcatgggggcaatttgttttaatcgccgtttcacttgagcagcttttttgggctgccggcttctttaaagaacatcacaatgcctttctgctggatacgcgcaaggtcattcatcaattaaaaaaggtgcgttttttacagctgttttctgtttttgccggccaggcgatcaaaaaaaccattttcgtatggtatctttttgtttttccggtctttttgtttttatcaagcgcaggcatgaccgggtctgcggcgatcatcgtatttttcttgggcttcgtttattttcttctcaatttatttttatctatgctgttttcttatgttgtttatcttcttacaaatatatggagcaaattgttttacttgaaaatcctgaaaggcattttattcagcgtcagcctgctggttccgcttgcagtcgggtatgccgtttatcttctcgtgtttggggagtataccgcaaaggatatttcaagctttacggagtcaccggctttccggaacatcctcatgaatacgccgtatgtatggttagcattccgctcacattccgtgctcgttttcgctgcggtgtttgcggccgccgtccttttaacggcggggatgtttaaactgtggtcggccacgctgaagaaaatggaccttattccttatatgtttttgacaaacgctgattttgcgccaaagctgaaattatatagaaataacaaaatatttcatgccgtttttcaaaaggatctgctgtttttatcgagaattgacgggttttttatcaggaacttcggcagtatgctgtatttgttcatgctgtttttaggtttttgtattccgcttctatcgcatcactttatcgggtattcggcagccgccatcgtgtctgcggcggttatcattgcgaacttttcgtatcagctcgtcggagatgcgctcaaaacagtattatcagttgacggggaaataaaaaatcagcatctgtttcaccggaatatcaaacatgcgtggcagctggtgtttccgaaagtatgtatttataatctcgccgctcttatctattcgttcatcatcaccattttgattacggtgttttttccgtcttccgcggcgctgacgatttacctgtttattgtgtttttatgttcgggttttttatacagtctcgtccagatttcaagcaccgccctgtatcctaagaaaaactgggagcatctgtacgaaattggagaagcggggaaagcaaagacgtataacaacttatacagttctttcattttcattgtgtcgcttcaaatcgctgcgatcacgtcctattttatctataaaaagccggaacttgaaacgatgcttattcattctgcatcaggtatttttgtcctgttcacactattaaactatggagtcatgtttctgtttcttcgcagaatcaatatggcggaaaggtttgcgaacaatgattaaattagtgaatatacaaaaaaactatagtgaaaaacaggtattgaaagatatttcgtttgaggtgaaaaaaggctcaatctatgctttgctggggactaatggagtcgggaaaacaacgactttgaaaatcatttcgggcctgcttaaaccgacttcaggccgcgtcatgattgacggcaaggaactggattcagaagagggggggcaaatatcggctgatatcggttttgtgcccgaccatgcttttttatatgattacttaacgggagtcgaatacttgcgttttacagcggaaatgtttcaagttccgtctcagcggacaaatgattatataaagaatatgttggagacgctgaagctttctcaagacggaaatcagctgattaaaacttattcacatggaatgaaacaaaaattatcaattgcggcagcgctcattcatcagccaaagatattaattcttgacgagccgctgacgggcattgatttaatcagcggtaaaacgatacggacgttattaaaggagtacgtcaagcagggaaatacagtcctgttatcgactcacctgctggagctggcgcattcgctgtgcgatacgatcggtattatacatgaaggcgtttttgcggcggagtatcagtcatccgagcattcattagaagagattgaagaattggctgagcgtatctatacatgatgaaccgcatgttgccggcaatcagaacgtccgccattccgttaaccgcgtcagtgctgtttttttcaggcggtgtgatcgctgcgtttttttccgatcactttgtttcatcagcgtcttacaacggctcgtcaggcgcggttgaactgctgaaaaacaatgcaatcgcttgtctgtttttagccgcgggtttttttacctttgggttgacctcaatcttttatttattcaccaacgggtttattttaagcggctctattatagaaaatctgcatagcggggttcctttttatcagatttttttactgctaattcctcatggtatatttgaagttcctgcgttattattaagtggcgccattggttttaagggcgttgaattggtcatcaggctgtgtttttctaaggaaaaaaagataatggtttcaatgttcaggcatattggaatattggtgctgcttattatttgtctgctgatcgccgctgccgttattgaagcttacatcacaccaatttttaagtaaaaggggcagaaatcatatgagaagtaaattatcattaatcggtgtgccgattgttatgattatcggttatatcatttctttatcctttgagtggctgtttcctgttcttacttttggggtggcaggactatatctctttatatttgctccggtgcaaaataaattcattcgttacatctttttgtttatttttgtgattaatctgttagccagtgcggctctttatttcggtatttaataaaaaaatgacattcaatatgaatgtcatttttttttatcttcgagcggctctgctgcatgttaaaatctgtcgccgttgaaaatagagttttttacgattacatagtcgacattacggatggcttcgagtgtattgccgccggcgtaagagatggaagattgcagatcctgctccatttcaaccagcgtgtcctgcaaagaccctttatgttcgacatgcatttttttgccctcgacgtttttcttttcgcctttttgaaattcagaagcggagccgaaatattctttgtacagctttccgtcgatttcgatcgtttgtcccggtgattcttcgtggccggcgaataatgatccgatcatgaccatagacgcgccgaatcggatggatttcgcgatatcgccgtgcgtgcggatgccgccgtcagcaatgatcggtttgctcgccgcttttgcgcaccagcgaagcgcggctaattgccacccgccggttccgaagccggttttaatttttgtgatgcagactttcccggggccgattcccacttttgtcgcgtcagcgcccgcgcgttccagctcccttacggcttcaggcgtcccgacattccctgcaatgacaaagctttccgggacatgttctttaataaattcaatcatgctgatcacggcattggaatggccgtgcgcgatatcaatggtaatataatccggcaccagctcctgttctttcagctcccggatgaattcatagtcattttccttcacgccgacactgatggaagaaatcagtccgcgcgctttcatatcccggacaaaagccagacgtttttccggctcgaagcggtgcatgatataaaaatacccgttttccgcgagccaggccgcgatgttttcatctataatcgtctgcatgttggccggtacgaccggaagtttaaacgtgtgtccgcccaacgtaactgatgtatcacattcagatcggctttcaacaatgcattttgcaggaatcagctgaatatcttcgtaatcaaatacattttccatatataacacccctaaaagcgaataatatatttaaataaaattaaaatgttcgtctttttataatgtactttgttttgtcaggaatgtcaaatgatttcatgctgcctcatatgcggtcagcttgtcatccatttgcagtttggttatcatagtagtattggttgttgtaagacatttgttacgatagatagatttgcagaagaagggaggggccggtatggaacaaaaacagcccgggcacagcccgaaagcccagaaaattcaggaccggattattttaggcacgatttgggtcgtgtcggcgcttgtcattgcgctcgttgtcggaaccgtcatgaattatatttggatgtttaaataaaaaagagtctgtgccggtatgacacagactcttttttatattatttttcaaacatgcttgtagaatgcagtggctggacgcgcgctttcgggtccatgtaagccttcgcgttgttcacggctgtcggagcttcgccgaaaccgctggcgatcagcttgactttgccttcatatgtgcagatatctccggcggcaaagaagccttcaatattcgtttccatcgtgcttttgacgacgatggaatttttctcgatatcaagaccccagtttttaatcgggccgagagaagaaacaaagccgtagtttacgatcaggtcatcaatttcaatgatttctttacggtcgcctttcacttcttcgagaacgagctgttcgatccggtcttcaccgacaagttcagcgggaacaaacggtgtcagcacgttgactttagaattatgcaggttttcgacactgtgctcatgcgcgcggaatttatcacggcggtggatgatgctgacttctttggcaatcggctcaagcatgagcgcccagtcaacagcggaatcgccgccgcccagaacggcaacgcgtctgcctgcgaattgattgaggtcgtcaatgaagtagtgcaggtttttgccttcatattgttccgctgattccagctcaagctttctcggcttaaatgcgccgtttcccgcggtgataatgaccgtttttgaataatgcgtttctgaattcgtgacaagcttaaacacaccgtccgcctgtttttcaacagattcaacggcctgctctaagcagatggtctgatcgaactttgccatttgctcttttaagttgttcacaagttcctgggcgcggattttcgggaatccggctacatcataaatatatttttcagggtacagcgcgctgagctggccgccaagctgaggcaggctctcgatgattttgacgctcgcctgtctcattcccccgtaaaaagcggtaaacaggccgaccggaccgccgccgatgaccgtaatatcataaacctttgaatcctcttgcataccaaattgcctcctaattgaaaattgttattaattataacatacaatttgaaaggatgacgagtgccgaaaaccgcccggccgcttcattcttgaaaaaaattgcggccgccgctaagatggggacaaattccaatctgttttttcctgaatgttttccgattcttccggatagtatggtgatatgcagacatgtgcggttttctaaaaaattttatatttcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaagcatatcggggcaaatgacgccgacattactttggtcaataaacacaattatcattatgaaacgacatggatgcatgaagcgagcgcaggaacgctgcatcatgaccgctgcagatatcaaataaaagatgtaatcaatgaatcacgggtcaaatttgtgcaggataccgtaaaagcgatagatgtgcaaaataaaaaggtgacgctttcacaaggggacatcccttatgattatctcgtcatcgggcttggcgccgtccctgaaacattcgggattaaaggtttaaaagaattcgcttttccgatcgcgaatattaatacgtcgcgccagctgaaagaccatattgagctccaatttgcgacatacaatacggaggccgaaaaacgccctgaccgcttaaccatcgttgtcggcggagcgggctttacgggaattgaatttctcggtgaacttgcgaaccgcaagccggagttatgcagatattatgatatagatgaaagtctcgtccggatcgtctgtgtcgaggccgccccgacggttttgccgggatttgatccggagcttgtcgattacgccgttcaataccttgagagcaaaggcgttgaatttaaaatcggcaccgcggttcaagaatgccgcgcagacggtgtcacagtcggcaagaaagatgaagagccggaagaaatcaaatcgcagaccgttgtctgggccgcgggtgtgcgcggacatccgatcgtggaggaagcgggttttgaaaatatgcgcggccgtgtcaaagtcaaccctgatcttcgggcgccgggacatgatgacgtttttattctcggcgacagctcgctctttatcaatgaagagacggaacggccgtacccgccgactgctcagatcgcgatgcagcaaggagaaacggtcgccaaaaatctgggcggtttgataaaaggaggccagcttgaagagttcaagcctgacattaaaggaacggtcgcctccctcggtgagcataacgccgtcggagtcgtatacggcaggaagcttaaaggcacgccggcgtcctttatgaaaaaggtcattgataaccgctcgctctttatgatcggcgggctgggcctgacgctgaaaaaagggaagtttaaattcttctgaaaacccgcagccgcgggttttctcttcttttaaaaaagagcgctataaaaagcatgtaaaagaaaaaaaagaatgtttccgcttacatgagttgttatgttacatattctgacttggtgcttgacaagtaaatatgatatattatcagaaaattaagaaaaagggtgatccgcatgaaaacgacagcaaaaagcacggcggcgtgtccgttctgctcaggtaaagggtattttcaattgcttcttggcggctccgaaacatgtccctcctgccagggaagcggcaaagagagacgctgatttttccagacgttgacttttttaccgccccgaggtacactgaaagtgctgtagggggtggatgtttgtgattagtttgccggttgtcctgatctcaatcgtactattttttgtactgtttttcggcataggctttctgttgaacatgctgcttagaatgtcgtggattatggctgttgtctatccgattgtatgccttttcattatcagcaataaaaagatgatcagttacgtgcaggcgccgggggaatcctttcaaagcctgtttcagcgcatcatgtcattagcggttgcggatgtcgtgattttggcgggcggactggcgggagccatcatgtcaggcattgccataaaggcgctcagaaaaagaggatatcaaatgttttaaaccgctttcttattcaagaaagctttttttgtgtcacggcgctttttgtatagcacctcaccgagttgggaacaatgactcggaggagagtgatttcagattgacgataatcagacgcgtattcatgatcgtgctctttttgggcgcatgccatgcgacatacttttctataaccggtgttgaagcaaaggatctgacaaattggatgacggaacatcgcggcgccgttttgaaaaacatcggcactccgtttcaatccttacagaatcagccggaaaagaaggcatcaggcagggtaaagccgctggaagaagcttttgactgggaacgctatccgtcacaaaaagtgacggccaccggttataccgccggagcggaatctaccggaaaatctccgggtcatccgcagtacggaattacatattcaggtgtgaaggtcaaacgcgatttatattcaactgttgcggccgatccgtctgttttcccgatcgggacgattctgtttataccgaattacggttacggggttgtcgccgataccggctcaaaaattaaaggcagccgccttgacctctactttgacaccgtcaaggacgtctataacaattggggcaaaaaaacacttgaggtctacattattaaaaaagggaacggcacagtgaccgaggacgaacttgtaaagctgaacgaaacaaagtcgctgcaagtgttcagaaatcaatacaaaacggtaaaagaataaaaacgcttcagcatccgctgaagcgtttttacataaagaaataatctaaaatcaatgtcagcacaataccggtgacgccgccgaagaacacttcaatcggctgatggccgagcagttctttcagtttcttctgtttttctttctcttccgctttctgaaagtccttcgcttcgctgacaaaccgattaaagtcgatgaccagtttattaatgactgtcgcctgttcacccgcatgccgcctgacacctgtagcatcgaacatcgtaatgacggcgaaaatcgcggcgactgcaaacaggggcgagtccagtccctgttccaaagcgattccggttgacagcgcggtgacggcggcggaatgggagctcggcatgccgccggtgctcgtcacaagagaccagtcaagttttttggatacgataaattgaataggcacttttacaacttgggcaaaaataatggcggcaaaactcgccagtaaaggaaaattcataagtacatccatatgcgacatcctttctgtatctgctgattccgatcgtatcgaaaaactgcagaaaacgcccttagtttggtaaaataaaatcaatgaaaaatgttttttcattataccactttacataacaaatacccacataaggagtgtgtactcatgttttatgcatctgatcaactgcggcatcccgaaacactggtcatcggtctttttcaaaaaagcacgctgaacggatttacgaaggaattggatgataaattagacggtcatctgacccagctgttaaaggatggtgatgtgtccgccaaacgcaatcgtgtatcaaaagtataccctccggctgcgaccggtatgaaacgtatttattttatcggcctgggaagagaagcggattattcgtttgaagatacgaaagaatgctttgcacgagtatttcagcagattcatcaagataaaaaacaggaagtatccgtgttgctcgatacattcgtctccggggaagtgcctgccgccgatgccgctcatgcgctttcggaaagctgtctgcttgcggtttatgaggtgcaggattataaacataaatcgaatgagccggatcaggaactgaaatcagtctgcgccgtgaccgaagaagacctgagggaagtgcaggccggcctgaacgtcggcgcggcatacggccaagggacgaattcagcccgcacgcttgtgaatatgccgggtaatatgctgacggccactgatttggcgtcatatgccgctgagcttgcggcaaaatacgatttcgagtgtgaaattttagaaaaagatgaaatggaagagctcggcatgggcgggctgcttgccgttaacaaaggctcatccgaaccgccgaaaatgatcgttctgaagtatcagggcaaagatcagtgggaagacgtcatcggcctggtcggtaaaggaattacctttgatacgggcggatattcaattaagccgaaaaccggcatcgtcggcatgaaaagcgatatgggaggggccgcctcggtattgggcgcaatggaaattatcggcgaactccggcctgaacaaaacgtgctcgccgtcataccgtctacggacaacatgatttcgtccgatgctatgaagccggatgacgtcatcgtttcgctcagcggaaaaaccattgagatcctgaacaccgatgcggaagggcgtctcgtgcttgccgacggcatcacatacgccaagcagcacggagcctctgtccttgtagacgtcgcaacgttaacgggcggtgtcattgtcgccttaggtaacgaaatgacgggcgccatgaccaatcacgccgcgttttatgaacaggtggcggaatcggcgaaagaatccggcgagccgatctggcagcttccgattacagaaaaggataaaaaacgggtgagaaacagtcagatggctgatttgaacaattctccgggaagagaaggccacgcgattatggcgggggcattccttggtgaattcgcggaaaacacgccgtgggttcatctcgatattgcgggaaccgcgacggcgaataaagcgacatgcttcggccctgccggcgcaacaggcgtcatggcaaggacgttggctgttttgactgagcggtttacgcccgaaagataacagcatcccgctgccttgatgcagcgggttttttgatttccaaaatctttagttgactaaagcgcagaatgtatgttaactttaattatctactacattagcaaactaaaggatttttggagggactcatcaatgaatgctgttgttgtcgcagtattgcttatgctcgtcttaagcctgctgcgtgtcaatattattatagctttaatgatcggcgcgcttgccggcgggctgaccggcggcttaggcctcggagagacggtgaaggcttttacggacggtctcggcggaaatgccaccgtcgcggtcagctacgcgctgctcggagcatttgccgcggcgctgacgaagacggggcttcccgatgcaatggtggaagcgtctgtcaaactaatcggaaaaaaggaagattcgcggaaaaaagcactgtcaaaagtgttaatcgtactggttattttaatcatatcctgtttctcgcaaaacgtggtgcccgttcacattgcgtttattcctgtattgattccgccgcttttaaaaatatttaacgaacttgaaatagaccgcaggctgatcgcgtgtgtgatgacattcggactgactgcgccgtatatcgttctgcctgtcggattcggacagattttccaggggatgctgagagataatatggcgtcagccggtttaaaggtgccgctcagtgatattccgtatgctttaatcatcccgacggccgggatggtagtcggtttaattttatccgtcatcgtcttccggaaaccgaagaaatatgagacgaaggagattgccggactgtcgtcttctccttatacgaaaaaaagcattgccatcgccctgatctccattgccgtgtcgcttgccgttcagctctatctgtcacaagtgctcggagtggaaggtatgatcatgggcgcgcttgccggcttgtttacgctgtttatcagcggagtcatgaagcgcaatgaagcggataagctgatcacggacggcatgattctgatggcttttatcgggtttgtcatgcttgttgcggccggtttttcaaatgtattgaacaaaacgggcgatgtggcttccttggtcaaagcatcaacaggctttatcggtcacagtcaatcattaggcgcgctcctgatgctggtggtcggtttattaatcacgatgggaatcggatcatcatttgcaaccgtacccgtcattacgaccatatttgtcccgctgtgcgctcagctcggattcagcccgatggcgacgatcgccgtaatcggagcggccgccgcggtcggtgatgcgggttctcctgcaagtgacagtacgctcgggccgacgtcaggcctcagcgccgacggacagcaccaccacatttgggatacgtgcgtaccgacatttattttctataacattccgcttgtgatattcggctggattgccgcgcttgtcctgtaaaaaaaggctcccggaaaggggagcctttttgtatgctgagaacatcttacgccggatttctgctgaaccccgtcgctttatgaatagacctgtatacggcaggcgcgattgatgccaataacagtgctaaaacgatatcttttatgaaaaaccatatcatgtaaaaccaggccattccgtagctgatcggagcatgaagccataatttcagcgcaatatacgtataggtcgtgccaatgatataaatgacggcggtaccgatcaaagaggcccatgcataatgcaggcggccgggtttttttgttttttccagcagccatccggctgcaaatgccgccgggatgtaagcgagaataaacccgccgctctttccgataaacggcgcaaagcctgctgagaattgagcgaaaacaggcgcccccgcgagtccggccaatgcgtataccgtcattgcaatggctgcccgtctggcgccgagaagcatcgcggctaacagacaaaagaaaggctgcagcgataacggaattcccgcaacttgcaaaaaaggagccattgatgtaatgttggcgccgacggccatcagggcggcaaacatgccgatcagcgccatatcgcccgcgcgaaggttgcgttgtgtcatttgtttttcccccttacacttgtaccagattagcgtaatcgaagggtgattgattgtcaacaaagatttaatacaggtttactaaatggagggagccatatgtttttcgggaaaacgaaacaaacaaaacagtcggaacggattccgccaaatcaaaatgtcacaacgaagtttcccgtgcttcacgccggaaatgttccttattatgaagatatgtcaaaatggaatctgcaagtgtacgggcttgttgaccgtcctatgctgttaagctttaaagatatcaaagcctttccggaagccgaagtgaaaaatgatattcattgcgtcacgggctggtcccgtcttgataatatctggcagggaatacgcgccaaagacatcgctgagaaagcgggtgtgcacaaagaagcgggattcgtcattctgcacgctgaagagggctggacggccaacctgccgctttctgattttacgcgggaaacatccctgctggcatatgcgcataacggcgagccgttaacgccagagcacggctatccgctcagaggcgttttcccccatctttatttctggaaaagcgcaaaatggctgcgcggcattcagtttacaaaggaaaaccaccccggcttttgggagaaaaacggctaccatatgaggggagatccatggaagaatgagcgctttacatgggattaagcccctatccctatatagttcttaggtaccttattaaaataaggtgctttttttatatcaaaaatccattgactttgtttggcaaaaaacctattatttgaggtgtcttttgatattgaaaatcattatcaatgaggatagataaagtaattgccacaaaggggatgaacacataatggacggaaaacaaataaaccgggggttcgcgccggccggccgatacgcggttccgggcacagaagtaagagaaatgcgctcaaaaggaggccgtacgtatcgtatctttgtctcttttcctcaggaagaaccgcctgcctccggcttccccgtcatctacctgcttgatgcaaattccgtgttcggtacaatggccgaagctttgcgggtgcaaagccggcggcctgaaaaaacaggcgttgttccggcggtgattgtcggaatcggctacccgacagatcagccgttttccgccgaacggcacagtgattttacgatgccgctttctgaatcagaactgccggtgcatccgcgcggcgcggcatggcccgaacagggaggggcggaagcgtttctggagtttatagaagaagaagtaaagcccgcgatggagcgggattatccgatcgacagagacaggcagacgattttcggccattcgctgggcggtctttttgtgctgcaagtgcttttgacgaggccggacatgttccagacctatgttgcgggaagtccgtcaattcattggaacaagcgttttattcaggaaaacgcagaacgtttgtcagaccggctctctgcggaaaatcttcaagtcagtgtattgctggctgcgggagaaattgaaaaaacacataaaagcagaatcccgcagcacgcagaggcgctgtactctttattatccggatttgaagatgatggagtccgtgctgaatacagcgagtttgaaggagagggccatatttctgtcctgcccgttttaatcagcagagccctgcgtttctgcctgaatccgggagggccgcataccccgtattctcccacatgagaaaaaacaggcccttcgaactaaatgcggctgattctaattttctaattgactgcgtgttttgatttggatatgattgtcttgaatcataattgataatgataatcattatcaatatagaaagggaatgataatatggacgcattgggaatgaaagggaaaacggccgttgtcaccggcgccgctcaaggcatcggagaagcaacagcgcttgcccttgctgaacaaggcgtaaatgtggcagctatagatacaaatgaagacctgcttcccgggctaactgacagacttcggcaaaaaggcgtgcaggcgcaggggtttgccgcagatgtatctgacagtgcggctgtcaatgatatcatcgctgccgttgaacgtgacatggggcctattgaaatattggcgaacgttgcgggcgtgctgcggccgggtccggtgcaatcccttagtgatgaagattgggatcaaacattttctgttaatacgaccggcgtatttcatgtatcgcgggctgtaagccggtacatgattgagcgtcaaaaaggcgccatcgttacggtcggttcgaatgcagccggcgttccgcgtgcttccatggcggcttatgcggcgtcaaaagcggctgccgccatgtttacgaaatgcctcggactggagcttgcggcccatcatatccgctgcaacatcgtatctccgggttcaacggaaaccgacatgcagcgggcgctgtggcgggatgaaaacggagcacaggacgttatcagaggttcgcttgatacatataaaacgggaattccgcttcaaaagctggcaaagccttctgatattgcaaatgccgttttgtttctggcctctgaacaggcaagccatatcacgatgcatgatttatgcgtggatggcggcgctactttaggcgtttgatttaacgagaaggagggacaaacatgacaaatcaacatgtattgacggaagtgtctgcaaaagaggtgctggacgcttacaagcccggagcgttctttttagcttccccgaaaaggacgctccttgcagaaggtgtgtttgcaaaagtgccggatgcagacgcggagaatcagctggattcactgcctgaacgcgtaagacagacgcttcttgaggcaaagcaagccggcatcaaacatccgattgcggccggcgccattccttttgacggcagaaaagcttcccggctttttgtaccgaagaatgtccatacggcaggcccgctttcgtttgcggaatcttccgcagaaaagccgcaatccaatacatatgacatccgtcccgttccggagcctgagggctttatgagcggtgtggaacaaggcgtattcaacattacggacggcccgctcagcaaaatcgtgctgtcaaggacgcttcatctgaccgctgaaaaggatatcgacattcctcaggccgtcaagcatttggcgcagcacaacccgcgcggctatacattcgcttcggatgtgacgggaacgtcagaaacaagaaaaacgcttttcggcgcaagtcctgaactgctgctgtccaaaaacggaacatcgattctgtccaatccgctggcaggttccagacctcgcagcacagatcccgccgaggatcagagaagagcggaagaactgctgcaatcagcaaaagatctgcatgaacatgccgtagtcgtggccgccgtggccgccgccctaaaaccgttctgccgtgtgcttgatgtgccggaaaaaccgtcactcattaaaactgaggcgatgtggcacctgtccaccgaggtaaagggagagcttagtgatccgtcaacgacatcgcttgagctggccatcgctcttcatccgacgcccgctgtatgcggaacgccgacggatgcggcgagagaagcgattcaggatatagagccgtttgaccgcaatttctacacgggaatggcgggctggtgtgatgctgaaggtgacggagaatggattatcgcacttcgctgcgccgaagcggaaacaaggtctctccggctctttgcgggtgccgggattgtcgccggatcaaagccgcaggatgaactggacgagacatcggcgaaattccgcaccatgctccgggcgatggggctttaccaagatgagttgtaaaaaaggagggaacggatcgtgctgactggatttacgccatggccggaagaatgggctgaaaaataccgaaaagacggctgctggaagggtgagacgttcggaggaatgctgaaagagcgcgcggctttatacggaaatcaaactgccgtgacgtgtaaagatgtacattggacctacaaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatacgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgtgttgttctgtcaccgacgccgagtccggatgactgcttcccgttaattgaaaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgccccggagaagcgggacatttgtttacacgcggcccttacacgattcgcgggtattataaagcgcctgaacataatgaaagatcattcacagccgacggattttatcagaccggcgatatcgtcaaactgacggcggacggctatatcatcgttgaaggacgtgcgaaagatcaaatcaatcggggcggcgaaaagattgccgctgaagaggtggaaaatcaccttctggcccatcctgccgttcatgatgcggccatggtttcaatgccggatgattttctcggagagcggtcctgtgtgttcgtcattccgaaaggagaagcgccgaaaccgggagagctgaaagcgtttttacgggagcgcgggctggcggcatataaaattcccgaccgggttgaatttatcgcttctttcccgaaaaccggcgtcggcaaggtcagcaaaaaggaccttcgcgaaacgatcgcccaaaaattgaagcctgctgaaatcaaacaatcttaaaaaaggaagtgtttacattggctataccgtcaattcccgcatatgcgctgccgacagcgtcagatatgcctgaaaataaagtatcgtggacgctgaacccgaaacgcgcggtgcttctgatccatgacatgcagaattatttcgtcgatgcttttgagaaagggaaggctccgatcacggaggcggctcagaatatcaagaaaataaaagagcaatgcaaagcgctcggcattccggtggtgtacaccgcgcagccgggcagccaagacccggcggaccgcgcgctgctgacggatttttggggaccggggctgaaaagcgggccttatgaagaaaaggtcattccggagcttgccccggatgatcaggacattgtcctcacaaagtggagatacagcgcgtttaaacggacgaatctccttgacatcatgcgtgaaagcggcagagaccagctcatgattacgggaatttatgcacacatcggctgtctcgtcacagcctgtgaagcatttatggatgatatccaaagcttctttatcggagacgccgttgctgatttttcttcagaaaaacataagatggccatcgaatatgcgtctcagcgctgcgcttacacggctttgacaaacgaagtgctggagctgctgggcggcgcgccggtttctgaaggagaagggaagacttccgccgtattgacaaaagaccgggtgcgggaacaaattgcggcgattcttcaagaatcaccgtctgatattccggatcatgaagacctgctggacagaggccttgattccgtcagaatcatgagccttgtcgaacaatggcgccgtgacggagctgaagtgacgtttgttgaactggcggagaacccgacgcttgaagagtggtggagacttctttcttcccgatctcaaaaagtcttgccgaacgcagattatttataaagggagagaatagaatgcatgatacacaacagctgcctctgacaggcgcacaggccggtatctggtttgcgcagcagcttgatcctgataatgcgatttacaatacaggcgagtatgttgagataaacggcgcgatcgatgtgaacatatttaaaacagctctcgaacgtgtgctgacggaagccgtgtcattacacgcccgcttcgaagagggagcagacgggccgaagcagatcatcaatcctccatttgaagctgcgatcgatgtcatagatgtgagttcagaagctgatccgaagcaggccgcactcagactcatgcagacagatttggctgagcccgttgatatggcggccgggcctttgttccgcgacattttatttcaggcgggaccggaacgctttttctggtatcagcgcattcaccacattgcgatagacggctacggtttttcactgctggcacggcgtacggcgcaaatatacaccgcaatacgggaaggacgtccggataacgggcgctccttcggctctttggaggaactggtaaaagaagatcaagaataccgcgcgtctgatcaattcctgaaagatcgggaattttggatggagaaatttgcggatgaacctgatgtcgtcagtttggcagaaagagcgccgagaacgtcaacaagctttcggagaagcacggcttatctttctgaaacggctttgcagcatgtaaaagcaattccgaactggcatgaagccgtcacagctgcagcggcggtatatgtccaccggatgacaaacgcaggggatatcgtgctcggtttaccgatgatgggacggatcggctcgatttcactgaatattccgagtatggtcatgaatcttctgcctttacggctttctctccgcccggatatgaattttcatgaggccgtcagccaagtggcaaaagaaatccgaaacatccggcgccatcagaaataccgccatgaagacatgcgccgcgatcttaaattgctcggagaaaaccgcaggctgttcggcccgcaagtcaatgtgatgccgtttgactacgctcttgatttcgcaggagcgccaggcaccgtccataacttatcagccgggcccgttgatgatttgtcaattaacgtttacgacagagcggacggaagcggaatgcgtgtggactttgatgcgaatccggaagtgtacagcgccgaagatattgaaaaccatcaaaaacgattcctgcttctgctggaatccgctgtgaaagaccagacacaaaaaatcggcacactcaaccttctgcctgaaagtgaacgtctctgcgtactggaaagctggaatgacacgcgcaaggccgagaagcagaaaagtctgccggagctgttttacgaacaggccgtaaaaacaccggaccggccggcaatcatcaccgaaaacgaagagctcagctatgccgaattgaacaagcgcgcgaaccagcttgccggcatgctaaaggaaaaggggctcggaccggaacaatttgccgctttgctgcttccgcggtcacaggagttggccgtgagcatgctggccgttttgaaaacgggagccgcatacctgccgcttgatcctgattttccttctgagcggatcacatacatgctcaaagatgcacaccctgcatgcctgattacaacgatggaattatccggccgcatgccggaagacagtgatgcaaaaaggatcattctcgatgacccggatacggtaaaaaccgttgccgctcaaaatgctgactgttccgatcaggcggaatgttcgcctttgcaccccgcttatgtcatatatacatcgggttcaacgggcaaaccgaaaggcgtagtcgtgacattaaaaagcgtaagcaatttcctcttatccatgcgggaaatgttcccgctcggcgcacaagaccgcctgcttgccgttacgactgcggcgtttgatatttccggacttgagctcttccttccgctcatcagcggggcggggtgcgtcatcgcacgtaaagagacgattcaggaaccgcgggcgcttgcgaacatgattcactcatacggtatttcaatcatgcaggcaacgccgacattgtggcattcattagtcaccaatgaacctgattccctccgggcgctgcaggtgcttgtcggaggtgaggcgcttccgaacgcgcttatgcatgctctgcttgaatcaggctgtacggtgacgaatctgtacgggccgactgaaacaacaatctggtcggccgcacagccgcttgcaaaagaccatacaggggcgcctccgatcggaaagccgatttggaacacgcgggtatacgtgctggacgccgcattgcagccagtcccgccgggaattgcgggcgagctttatatagcgggcgaggggcttgccagaggttattataaccgtcctgatttaacagctgaaagatttattgccgatccgtacgggcccgcgggcgcgaggatgtaccggacgggagatctcgtgcgctggcgtgaggacggctcgcttgattatatcagcagagccgatcaccaaattaaaatccgcgggttccggatagaattaggagaaattgagtcagtgctgtcgaaatacccgggtatttcgcaggccgctgttattgtccgtgaagaccagccgggagataagcgcctggcggcttatgctgtcgcggatcagccccttgatatcggcggacttcgtgaatatatgggcgaaagcctgccggattatatggtgccgggcgcgtttgtacagctgaaagaattgccgctgacgccgaataagaagctcgatcgcagcgctctgcctgcacctgatttttcagctgtcctgtctgacagagggccgcggacgccgcaggaagaaatattatgcgatctgtttgccgaggttctcggtctcgcgcgggtcggaattgatgacgggttctttgaattgggcggacattcgctcttagccggacgcctgatgagccggatccgggagacgatgggcgcagagcttggcatcggacgtctgtttgataccccgaccgttgccgggctcgccgcacagcttgacaccgcaaagagtgcgcggcctaagctcaagccgtttgaccggccggagcacatcccgctgtcatttgcgcagctgcgtctttggtttctctactgtcttgaagggccgagcccgacttacaacattccggtgattgtccgcatgtcaggcaagcttgaccaatcagcgctgaaacacgccttttacgatgttgtcagccgtcatgaaagcctgcgcaccgtttttccggaaaataagggatcatctcatcagcttattttacctgctgaagaagcccgccctgtgtttacagtgacacgtgcagacaaaaacgagctccaagacatgcttgccgctgcggcaagatatcggtttgatctcgctaaagagccggccgtccgggctgagctgtttgatcttggtgacggcgaatatacgctgatggttctcctgcatcacatcgcaggcgacggctggtccttgaatccgctcatgcgtgacttatccatagcctatatcgcccggcaaacaggtgaaaaagcagaatgggcgccgctggcggttcaatatgcggattatgcgctttggcagcagcagcttttaggcagcgcgtctgattctgagagcttaattgcgcgccagctggatttctggaagaaaacgcttgaaaatgtaccggatcagctggagctgccgtctgattttccgcgtcccgctgaatcaagctacaggggcggcgtcattccggtcaacatcggccaagagcttcatgcccgtcttctctcacttgccagaaatcagcgcgtaagcctgtttatggtgcttcaatcagggctttccgcactgctgacccggctcggggcgggaaccgatattccgatcggcagtccgatagccggccgcagtgatgacgcattaggagaccttgtgggtatgttcattaatacactcgtactgagaaccgatacctctggcgatccgagcttttgtgagcttcttgaaagggtcagggaaatgaatctcgcagcatatgaacatcaggacgtgccgtttgaacgtctcgtggaagaattgaatccggttcgctcccggtcaagacatccgctgttccaagtgatgctcgcattccaaaatacgcctgaccctgtactcagtcttcctgatatggaaacaagcctgcaaatcagcagtgtcggatcgtccaaatttgatttgacattggaattggctgaacagcgccatgatgacggcacgcctgccggtattgaaggcctgctggagttcagtacggacttattcagaaaagaaacggctgaagcacttgccggacgcctgcttcttctgctcgaagatgccgtatcacatccggataaaccgatcggaagcttaaccattctttctgatgaagagcgccggaagcttttgccggttaaacgggcaaaacagcatattcagcctcggcagacactgcctgaactgtttgaaatacaggccgccgcaaaatcggatgaaacggcggcagtatttgaagagagcggactcacttatcaagagctgaataaaagagccaatcagctcgcgcacatgatgattgcccgcggcgtcggcccggagcagtttgtcgcactggcgctgccgcgttctttagatatgattgtcgggctgttagccgtcctgaagacgggggcagcgtatttgccgcttgatcctgattatcccgcggaccgcatcgcttttatgttacatgatgccaagcctgtatttatgctcaccaaccgtgaaggcgcaagtaagctctctggcgaaaacggcatgccggccttcatcctggatgatccgcagaataaggaaacacttcggcaatatgccgtcacgaaccctgagaatgccgaccggattcgtccgctgagaccgcttcacccggcctatgtcatttacacgtcgggatcaacaggtgtgccgaaaggtgtcatcattccgcacagcaatgttatccggctgtttgagtcgacgcggcattggtatcactttaattctgatgatgtatggacgatgtttcactcctacgcttttgatttctctgtctgggaaatatgggggccgctgctccacggcggacgtctcgtcgtcgtgccgcatgacatcagcagatccccggaagcgtttctgcatcttctcgtgaaagagcgagtgaccgtacttaaccaaacgccgtcagcgttttaccagctgatgcatgcggaaaaagaacacaaagagctggggcatcagctcgcactcagatatatcatcttcggcggcgaggcgcttgagctgagccggcttgaggattggtacagccgccacgcggacaatcagccggtgctcgtgaatatgtacggcattacggaaacgacggtgcacgtcagttaccttgaattagacaaaaacattgccgaactgagagcaaacagcctcatcggctgcggcattcctgatctgaacgtatatgtgcttgatgaccggctggagcctgtgcctccggggatcacgggcgaaatgtatgttgccggagggggcgtggcacgaggctacttagggcggcaaagcctgaccgccgaacgctttgtggctgatccgtacggcccgccgggaacgagaatgtaccggacgggggatttagcccgcctgcggacggacggttctcttgattatatgggcagggcggaccaccagattaaaatccgcggcttccggattgaattgggggaaatcgaagcggttctcgtcaaacatccggatgtcgaggatgccgccgcagtcgtccgtgaagaccggccgggagataaacggctggccgcctaccttgtccgatctgccggcagcaccttggacacgggggacatgcgccggtttgccgaagaaagcctgccggattacatgattccatcagcttttgtccaaatgaatgaactgccgctgacaccgaatggaaagcttgaccgaaaagcgctccctgcgcctgacttccaaacggaggtcaccggccggggaccgagaacgccgcaggaagaaatgctgtgtgagctgttcgcagaggtgcttcatctgccgcgtgtcggtattgatgacagattttttgatttaggcggccattctttgcttgcggttcatttaatgagccgtattcgggaagcgatgggagccgagctcagtatcggaacactatttgaagctcctacggtggcaagccttgctgaaagacttgagtcaggaacgggcacaagcgcgcttgatgttcttcttccgctcagaacggcaggagaagaaacaccgttgttctgtgtccatccggccggcggtctcagctggtgttatgccgggctgatgtcttctttagaagctgattatccgatatacggcttacaggcgagaggcatcggaaaaaaagaaccgcttccgcaaagcttagatgacatggcggctgattatattgaaaaaatccgcaccgtgcagccgaaagggccgtaccgtctgctcggctggtctctcggagggaatgtcattcaggccatggcgacacaattacagagccggggcgaagaggtttcgcttttggtgatgcttgacgcgtatccgaatcattttctgccgataaaaaatgcgcctgatgacgaggaagccgtcattgcgctgcttgccctgggagggtacgacccggacagcctcggggatcagccgcttgattttgacaccgcgctgaccattctccgccgtgagggaagcgcattagccagcctggacgagtcagtgatgatgaatctgaaagacacgtacgtaaattctgtcgggctgttaggaacatacaagccaaagccgttccacggagatgtgctgttcttcagatccacgattattccggagtggtttgacccgatcgagccggatacttggaaaccgtatattactgggaaaatcgagcggtatgacttagactgccgccataaagatatgtgccagccgggcccgcttgccgacatcggcgcgattctggcagagaaattaaacggacggcgtacagtccggtaaagaaaggaaagagatgatatgacaaatccatttgaacgggaagacggttcataccatgtgctcgtcaatgctgaaggccagtactcactgtggccggcctatctggatgtgccggacggctgggaaacccgcctgacgaatgaaacccgccccgtttgtctcgaatatattgaaacaaactggcgtgatatgaggccggaaagcctgaagcggaccgaagctgctaaaatgtaataagaaaagcctgccgttatttcggcaggctttttatgcggacatcagccgttaagctgtgtatgatcacaaaatgtataagggtggccttcttcatccgtgcaccatgactgagacagaaaagccaaaaagaccgcggcccactggtctgcaaactggattaaaataccgccgtcgtgccacgttccgttatccttcttccagcgtgtatcaattgggtttccctgattcatatgaatattatgcatgccgtttgtcggcttgaacccgaaaatcttatcagcgcccggctccggcccgaatttagagccgtaaatatagacggtggctttttctgatttggctttttgcatgtacgtctcaataaagtcatttaagtcattatccggaccggtgacttcatgcggaaggggcaccatgttccggggatcaaacaatccgccgcggacataatccagcgccagctcacgtctggtttcatcaattggggtatatccgtacggaatgttcggcagcagggtgatcgcgcttgcgtcaaaatgatcgcgtgccgcatacagcacctctgattcttttgaacttgacatgacattgatcgcacagcgatagcgcgtatcaggctcgcctagcacctcgacttgaaaatgcggagaatcatcatctgtttcccttttcatatctaacacagtgccttttaatacaccatagtgctgaacagccatatgaatcctcctttttcttccgggatatgaattgatattcgagacagggggccgtttttccttttgtgagaaagaaaaaaggacagcccgctgatcaggctgtcctcttcatctctattaagcttttgcagccgaaccttgcattgctttttcagcaggcacgtagtcatagcctaagtctttggctaccgcttcatacgtgacatgtccgttagccgtatttaagcccgctttaagcgcagggctgtctgcaatggcttgtgccgcgcctttattggcgatttgaagcgcgtaaggaacggttacattcgttaatgcgagcgtagacgtacgcggtacggcgcccggcatattggcgacagcgtagtgaacgacgccgtgtttttcgtaagtcggattatcgtgggttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggaatctgcaatatttacagggtttgacatcaatgttttaatctgatgcccgaaaatatcatcaagctgacgcaggcggtctgcgttcaaatcgatcattgtcacatcggcaccgagtccgacagccattttcgcggcatttgttccgacgccgccccctccgatgatcgtgacttttccgcgggatacacccggtacgccggctaataaaattccttttccgccctttggtttttcaagaaactgtgccccgatctgcgcggccattctgccggccacttcggacatcggcgtaagcagcggaagggaacgtccgtccgttaccgtttcgtacgcgatagctgtcacacctttttctgtaagcgctttagctaattccggctctgcggctaaatgaaggtaagtgaacaagaccagaccttgacggaaatacgcatactcttcagccagcggttcttttaccttcatgaccatttccgcatcccatacttgctttctgtcctccagaatttccgcccctgctgatacataatcttcatttgtaaagccgcttccgagtcccgctccggattccacaagaacccgatggccgtttccgataagctgtgaaacgcctccaggtgttaatgccactcgattttcattgtttttgatttcttttggaaccccgataatcatgtctgtttcccccaatgtttgtgtgatgcttcaagtgtagcgcgatttttgcgaaaattctttgtttgaaacagaaaataaaaaaacacggatttgtgaaatttcacgaacccatgctgcgaagtttgatatccaggtaaatcgtaaacttctcattcacattttttaagtcgatttctgcgatctggctgattcttttcagcctgtaattcaatgtattgacatggatgttaagcgctttagcggcggtgttgacattgctgtcggcatcaataaaatgttcgagcgtttttaccatatcggcttggtgctccctgtcatactgctcaagctttgacagggaatagttcatatagccgctgtgcttgcgtttttcatccaacacatcaaggtactgataaatgccgagttcagaaaagctgaaaaggtgtttggtttctctcacaaaccgctctttcgcttttaatacggaaagcgcttcctgataggatcggtaaacgtaagaaatcgattcgtaaataccgccgatcgcaatcgacgcatcctcaattttatatcgttccttcaactgtttttgaatatgaagagcgaagtgctttaaatctttaaaaggctgatcggttttcggcgcggctaataagattaattcatttgaatcaacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatctcggcttcctgataaatatggccggtcagcattttccaaaaaaactcctggccccgctcttcgattttcgttttgcggatctgcaggtgcaaaagcttgttccgcaccgctttggctgccagctgaagtgtcttcagatcttcgtcattgagcttttttttgatctcaagcgcccaaataaatccgagaacctgactgtttttccagatggaaatcgccacgcggttgcttaggcccacctcgtcaatttctttcactttgatcggctggtccgtttttaaaagggccggaatggttccgtctttccacagtttgttgatgactttttccggcaccctccgcccgataatcgtcgacgtccgggcaggatctgtacaatcgctgtgcgtgctgtatgcaagcagtttatgattaacgtcttctattgtaatggggcattgaagaacttcactgatatggtcggcaacatcttcaagcctgtcgaaactgtacttaaatggatcttttggattggtcatctgtatccctactttttcatagcttcatatcttgatcttaccatcttgcttttcagactgaaaggcatctttgcagggaaatagactaggacaataagatcattcagtgaaaacgaaaataataagaaaatcatactattttatttacaaaatgtgtaattatgacgaaaaatccaatatatcataagactcattttgtaaaattaaaacagatttgtttgactgtgccgattggttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggaaggtgcttcaagtgaagcattcgcggatcaatatgagcagctgaaaccttcatttattaaaatgtctgaattgcttcaagatgtgaatcatcagctcgatcaaacggcaaatacgcttgagtctaccgaccaagatatcgctaaccaaattcgcggataataagatgaatgaagaaacggagcgcctgattcaatcaagaagacggcgctctttctatgtaagggtgatatgaatatgtatatcgatattacaatagatttaacacattataacggcagcgtcttcgatctcagattgtcagattaccattctgtgaaaaaagtcattgatattgcccggcaggctcagcatgtatccgttccgccgcgtgaaggctattggatcagagtggtcaataaagaaacggttttttccggagaacaaaagctatctgactgcggcattacgaacggagaccgccttgaaattttatgaaaggacatggtggaatgacaggtcataacagatcttatttagaaacagaattagacgccgtccgggaagaaaccgaatcaggcttcacgttcaccttccagcgggaaaaaatcaagcttcttgacgggctggaagcgaatgtgattaaagatgccgatcctttttttcaaaaagaggtctcagtttcagaagacgaagtaaccatcacaatcaaacctccttcttcttatcaggctttccgctatataaaaggaaaagataaaaaaagcaggtggcaatttgcctaccgtctcgtccaagccgtgaaacagcataagctgaaacgtctcaatctgattgccgcccctgaaaatatcgtgtttgataaagcgctgacgccttactttcttcattacggcgtaaaggagagccttccgccttatgaggaagatagagaaagggtgttaaaagagctcaaagcctgtgcggcgcttgcagctgacggggcgtacaccttcgatgaatatttgaagtacaaggagacgcttcatttctctcctgaggtgaaaagcgtgttagaggcggagacgattgaagaactggaagaagccattcaaaccgcaatcgattccctcgaagaaagggacaagacatacataaaactgccgaaaaagaaatggaaaatccaaagatacgccggtctggcgcttgccgtcctccttgtgccggcacttctttactccttatacgttctgtttttcgtccagccgaagcaagaggcaattacggaaagcaaccgctattttttaaatcagcagtacagcaaagtcattgacacactcgctaaatacgatgcggaaagcctcccggaatctgtgcagtacgagcttgcttcctcttatgtggcagttgaaaatctgagggaagaacagcggaaaaacatcgggaatctggtcacgctgcaatcagacccgaagcacttcctttattggattgatatcggcagaggggaaaatgaagaagccatcaaaatcggccgcaatcttgagtacaacccgtacatctggctcggacttacaaaatataaacagcaattattagcggatgacagtatgaaagacgacgaaaagcagaaagaactggacgccgtggaaagcgagcttgcgaaggcgaaaaaagaggcggaggaacagcataaagaagcggaggaaaacagtgacaccgccgaagcttccgccggacaagatgaaagcaaacaagacaaagcgaaagataacaaagagaacgacaagaaagatgagaaaaaagatgaaaaaaaataacagcacacatcaaatggccgcatgtaacgatcaggctgtcgtcaggaggttcgccatatgagtctgttatgggtcttttaccgagagcacgtacaaaaggttcagctgtctgaactcccgccctctcagccgattacgatcggtccggatatgaaagatacaatcacggtcggcacacttccgttacggcaaaacgccgcaaccctttatcggaaagaaacagatcgttatgatgttttcctgggaaataactgtgccggcgaattgacaataggaaatgaaatgccctgccggattgaagaagagacgatgcggcttctgctcacccctgaccaggaagaatcctccgtgtactttatcggcgggaaggatgagatcgttttctcatcagaaacagaggaagcggatatatacaaagagccgtcctccgctcaaacaggggctttttatctgcgtaagtcgggaggatgctggtctgtcgtccctgatggtcaggaagtttatgtgaacggaaagcttgcagaagctcccgaaaggctccggacgggagatgagctgctgtggaattttctgcgtgtgaggctgacggaggacgaccttttagaaatcgttcatcacgaaaagcttcaagccggtttaaccaaaacggtaaaaccaagcaccgaaatgaaaaagaaatacccgcaatatcgaagaacgccgcgcatggtctacgatcttcccgaagaccgcgtttcattcagctttccctcgcaggaaagcgaacagaataaccgggggctgtggctcgtcattctgcctcctgtggtcatgctgattgtaatgggggttgtcgctattatacagccgaggggcatattcatccttgtctctttggcgatgtttatgatgactctcattacgtccaccgtgcagtatttccgtgaaaaaaccagcggaaaaaacgggaggaaaaacgggagcgtgtgtacaagcagtatttagaaagcaaacggaaagagcttcagacgctgtcggaaaaacagctgcacgtgctgacgcatcattttcccccgtttgaaaaaatgaaatatttaacttctgaaatcagcggccgcatttgggagaaatcgctggaaagcagggattttctgatgcttcggctcggaacgggcacggtcccgtcaagctacgagatttcaatgagcggcggagacctggcgaaccgtgatgtggatgacttgatggagcagtcgcagcacatgcagcgtgtgtataaagacatccgccatgcgcccgtgaccgttgatttacaagaagggccgatggggcttgtcgggaaacctcagatcgtcaaaaatgaaattcaccagctgatcggccagctcgcgttcttcaacagctaccatgacctgcgatttgtctttatctttcatgaggacgaatataaggaatgggaatggatgaagtggctgccgcaatttcagctgcctcatatgtatgcgaaaggatttatttacaatgaacagacccgcgatcaattgttatcgtccatttacgagctgctgcgggagcgggatttggaagaggataaagaaaaaaagatctttcagccgcattttgtctttgtcatcacaaatcagcagctgatcgcagagcacgtcattttagaatacatcgaaggccggcatgagcatctcggcatctcggccatcattgccgcggaaacaaaggaaagcctggcagaaaacattcacaccctcgtccgctacattaatgaagatgagggagacattctcattcaacagaaaaaagcggtgcagatcccgtttaagctggacaggcatgaacggacaaacaacgagcggttttcccggacgcttcggacattgcaccatcaggtcggaatgacgaattccattcctgaaacggtctcatttctcgagctgtttcatgcgaaggaagtaaaagaaatcggcatcaggcagaagtgggagacaagtgagtctgcaaaatcgctggctgttccgatcggctataaaggaaaagacgacatcgtctatttaaacctgcatgaaaaagcgcacgggccgcacggattgctggcgggaacgaccggctccgggaaaagtgaatttctgcaaacatatatcctgtcattggccgttcactttcacccgcatgaagcggcgtttttgctgattgactataagggcggaggaatggcgcagccgttccgcaaaatgccgcaccttctcgggaccatcacgaatattgaaggaagcagaaacttcagtatcagggcgcttgcatccattaagagcgagctgaaaaaacggcagcggctgtttgatcaatatcgcgtcaatcacatcaatgactatacaaaactgtataaacagggagaaacggatattccgatgccgcacctgtttttgatttcagatgaattcgccgagctgaaaagcgaagagcctgactttatcagggagcttgtcagcgcggcccgcatcggacggagccttggtgtgcatttaattctcgccacgcaaaagccgggcggcatcattgacgaccaaatatggagcaactcacgctttaaggtcgcgctgaaagtgcaggatgcaagtgacagtaaagaaatcctgaaaaacagtgatgcggcgaatattacggtcaccggacgcggctacttgcaagtcggaaataacgaagtgtatgagcagtttcagtctgcctggagcggcgccccttacatggaagatgtatacggcaccgaggatgacattgccatcgttaccgataccggcttaattccgctgtctgaggtggatgcggatgatgcggcgaaaaaagacgccccggcagaaatagaagccgtagtcgaagaaatcgagcggattcaaaatgaaatgggcattgaaaagctgccgagcccgtggcttccgccgcttgccgaacgtatcccgcgcacgctttaccccgcgcaggaaaaagaccgcttcttcatcgcctgcgttgatgagcctgatcagcaaagacaggcgcctctcgcttacacaatgatggatgacggcaacatcggcattttcggctcatccggctacggcaagtcagtggctgccatcaccttcctgatgaatttcgcggaaggatacacgccggaagagcttcatatgtacatctttgacttcggaaacggcacgcttctgccattggcaaagcttccgcacaccgcagactatttcttaatggatcaaatgagaaagatcgaaaaattcatgatccgcatcaaggaagaaatcgagcggcggaaacggctgttcagggaaaaagaagtcagccatatcaaaatgtacaattcgctcagtgaagaagagctgccgtttatatttatcacaattgacaatttcgacatcgtcaaagacgaaatgcatgaattagaaacggaatttatccagatttcacgcgacgggcaaagcttaggcatttacttcctgctgaccgcaacgagggtaaacgccgtccgccagtcgctgttaaacaacataaaaacgaaagtcgtccattatttaatggatcagtcagaaggatactccatttacgggcgtccgccgttcagtctcgaaccgatcccgggccgcgtcatgatccaaaaagaagaactgtatttcgcgcaaatgtttcttccggctgaagcggaaaatgacctcgagatgttccaggcgctgaaagctgatgtcaaagctttagctgagcgccacgccggaacagccggaccagacccgattccgatgcttccggatatgctgacggccggcgaattttcactccgtctcggcccggaacaagacccgttccgcattcctgtcgggcttcatgaggaaaaggtcagccctgtgtactttgatctgggtaaaaataagcattgtcttattttgggccagacacagcgtggaaaaacaaatatcctgaaagtgatgctgaatcacctgctgcgtgaaggtgcggaacgggtcgggctgtttgactcgattgaccgcggactgtcgcagtatgcgcaggaaacaaaggtcagctatctggacacaaaagaagacgtccggcagtggatcgaaacggcagaagccattttcacggagcgcgaagctcagtatacgcaggccgtcaaaaatggcgatgtgcacaaactcagtttctctccggtcgtgttaatggccgacggcattacaagattccagcagacgatcgacaccgccttacaggacaagctggcgatgtttatgaaatcttacgcgcatgtgggcttcagttttatcccggcgggcaatcacagcgaattctcaaaaggctatgattccttaacgacggaaatgaaacagatccgccacgcgatgctgcttgtgaaaaaatccgaacaaaatgtcattccgctgccttaccaaaggcaggaaccggacattcagccgggcttcggctatttggttgaaaacgggaaggagcaaaaaatccaaatacctttatgttcagcggaaagggaggccgtcagatgaccgaacaacgaaaaagcctgatcaaattaatagccgcggtcgtcatcattctgctgctgccggtgctgtttttccggtttatcggcgatgacccgggaaaacaaaaaatcaacgccacccgccaaatcgcagtcgtgaatgaagatatgggcttacaaacagatgaaaatgaggaagaggaatccgtccatttcggcaaagaagtagcggccgctctcggcggccgtccggattattcatggacggttgtcaacaggagcgcggcagaaaacggtctggcggctaagaaatatgacgccgtcgtttacattccatccgatttttcaaaagacatcttaagctatgacaaggagcgtccgcaaaaagccacgctgacattcaatattcaaagcaacctgaacgccgtcaacaaagaaaaagtgcagcgtgagcttgaagacgcccaaaaatcaatgaataaaaaaatgtcggcattatattggaatttcgtctcacaaaaagtgaacaatgtccgaggcgattttgacaagatcgtcaataaagaatcagagtttcaaaatgtcatgtacaacttttacaagccgagctccaatgacttggcaggtgaaatcaaacggcaaaaagacctgattgacgaactgaaaaaatcaatgaatgaagcgcagggcgcggcaaaagaaaaactgacttcggcagatgaagccaaaaccacgctcaaagactttgccgacacggtcgagcgctacaaacaatatcaagaaaatcagaaaaaactgctgatggccgcgcaggaacaaaatcaaaagcaaatcacaaccggactgaacgccattaaagcacagcaggccgccaaccagttcagcacgatgatgagcgggctctcttcaggcataaaccgggcgcagacacagcttgaccagacgggatcggctctttttgccgcccaacaggtgagagaagcgcaggttcctgatcaggaacgcgggatggcgaatattcaatccaatttactggacaattatttgactcaatataaagcgcaagcaagatttgaaacattgaacagcattcaaacccttatgaaaagggatcggccggcattaaccgttccggaaaaggacccgggtgatgacggctcggatgaaccgaaagaagaagaaaaaccggaagaagaaaaacccggcgatctgaaaattgaccttgacgatcagcgtgacgaattaaaacgcatctccgctgaaatcaatcacatttctgacggattaaaagaaccggaaaaagaaaaaccggaaccggaagaaccgggccaaggcgatgacggtgaaaactccggcgataccgatccgaataacggaacggctcccggagaagacggaaaaacggaagacggcacaaaagaagagcagcctgcctccgataacacaggcgatcaggagccaaaaaccgtccagacctcgacagccgctgaaaacgtcactccgcctgctgatgagccggcggacgatccaaacgattctgaaagggacggcggcacggacatatctgaggcaaaagaaaggctgaaccaagccgcagaacgcattcagcaaattgaaaaagagctggaagagaaacagcagactcataataaagaactgaaaaaacgtctcgatgctcttgatgaagaaatccaaggccttaaaaatcagattgccaaagttgaaaaacgggcagataaattaaaggaaaatttggaagaattggaagaaacgagaaaacaagacttcgataccgtttacagaatgattgtaagaacagaacagaacattctgaactacccgtcattggatagcggccgcaaatctgctcttgaacagatgtttgccgctgacatcaatacaaaaaagatatccgatttaatgagttactataatgatttatccctgtatgaggcgacactctatcactctcttgacgcgggctcgctgcctgatgtgaaaaaccgggtgctgaaagcccagcaaggtgaagtccaaaccgttcttgccatcaaaccggaagaaacggcaagctgggaaaatctgaaaaacaacaaaatgcagactgatgaagacatcagcaatttcattaaaggcatgaccgaattctcggataactacagctcgtatatcagagatgagcaagccggggtgctcgatgagcttgccagcatttcagacagcgcggcgaaagcatccgatcagctggctgaaggcgctgtgcaggaagcggccgcgttcagcggagacggattaaccggaacgatggcgctcggcgctcaggataccgtcggccgtgaagtcctgcaaatgtctgacacgatgggccatctgtcagaacgccagtccggcatcatcagctataccgacaatatgcagcaaagcgtaaatgacgtccagcaaaaagcggacaccctgaacagcaactggggcaaaaacgtcgattccacgaaattgatcagaaatgacgtgtacggcattttagggaacgcgctcgttgacggacaggaaaacggatatgtttatgattatctcgccaatccgcttaaaatcagcggagaggtgccggaagaccgggttcagaatgttccgccggtcgtcattttggtgatcgtcctgatcagcagtcttctgatcggctatttcagctcgtattatcagcaggcgccgcttcttgtcaaaggcgcgctctttgggattttaaacattatggtcggattgatgatcagtctgttcggtctgaatatctattcgcttccggatgatcagacgattaaatggtcagtctttacgattctcctgcttgcggcgagttcagcttttatccgggcagcctttgtcttcagctcaattaccggatggatcgcatcatcagcgctcattctcttttatgtggcgcctttgatcgacctgattatgccgaacttcacctttgacagtccggtttcgaaagtctatatcgatattcaatacggaacgggccatctgtttgcgttgggggtaacggttcttgcgatcattacgctgattgcggcggcgcttccgctcgtcattcggctgtttgcggaaaaaacggaggaaagtgatcagtcttatgaggcgtaacacgttcatggaaaaaggattgctgctgtttgctctctcctttttccttttccttccccaagccgcagccgcgaatgaggaaaatactgatgtcaagccgaatgaatatgaaaagaaagacattgaaattcgtacggactacctgcacgacgatgcctactccgaggaaaaaacggcgcttccgaaagaacagaaggatatcacgtttgatcagccggccgaaaacccggatgacaaactgatatcaaatttgtttacatcgtcagacacggagccgaatacgatcaaagcgcaatcgaaacaactgggtatcacatttgccgagccggcggtgcggcatacctcggcagatatggaaacggaagagaaaaagacttcttatctgcttcccgctatttatgccgtcttgatcctcctcgggattgcggcaatgatctatctgatcccgaaagtcacggcgcaggaaaaggcaaagcggtaaaacggatcgcttgtgtttgcgggaagacagcccgtaaaataagaaaaaaaggaggagtttcatgcagttttttcttataacaggcgcgtcaaaaggcttgggccgggcgcttacggaacaggcgcttcaagaaggagccgaagtcgccgcgctttcaagaacgataagcggggaaaagcgcgaggggctgacagaatacagtgttgatttaaccgatctcgcagataccgggcggcagatgaaggcgattcttgatcaagcagaggagaaggggtactccgccgtcacactgatcaacaatgccggaatggtggaaccgatcaagcgggcgaaagaggcttccgccgaagaattgaaccgccattacacccttaacctgacggcgcccgttttgctcagccaaatgttcacaaagcgcttcgaagcgttcagcggcagcaaaacaattgtcaacatcacatcgggcgcggcgaaaaatccttataaaggctggagcgcgtattgcagctcaaaagcggggcttgatatgtttacgagaacattcgggtttgaacaggaagatgaagagctgccggtccgcatgatatcattctcgccgggagtgatggatacagacatgcagtcggtcatccgttcttcgtcaaaagaagatttccatgacatcgaacggttccgcaatctgaaagaaacgaaaaacctcagaagtcctgaatacatcgccggcgtcattcactcactgatcgcgggcgagccggaaaacggacggatatacgatatcaaagaatttttgtagagcagctttcacgctgctctttttttgtttgtacaatcacttaggggtccggcggcatatgatgaatgaaacaacatataaggggtataagaaatgtatcagatgaattgagtttcttctcgatttatgttaggattctaaaaatatatgaaggaggggtttccatgagaaatgtaacgttaatggatgtcttcacccatccaatcgcacaaaagtatttacagcgttccggtgtcgcccatgcgatcgcctgcgcgtttcatgcataccgtcttgccgtaaaagcaggtgtcagcccggatctggcggcgaaagcggcattactgcatgacgtcggccattatgaatggtacacagacggcaaatgggattatgaaaagtacagaagaaatgatatccatgccattaaaggcgcggaacgggcgcataagctgctcatccggctcggtgaagaaccgaaagcggcgaaggacattgcgctggcgattctgcttcacaccgattcctatctgcctgaaggcgaactggacaagaatacgctccagcaaatcgtgaaacaagcggatgaactcgatgaagaacccggcggacatcaccattaccgccaaatggatcacacggccgcgctcaaacaaatccaaaagcttgatcagttaattgaccgagcccaatatcccataagaagctcagtctaggccactcatgcggccttttccgcttacataactccgcatgctcactaacaccttttccgctccgatagacgtactgtgtcaaagcctttgtccgctgcatatgctgaaggaaaacatagtaaaggggatcagcgaaaatggcccatcaaggaagcccgcaaatcgtctcgttagtggatccttacgtttatcagaccatccataagcttatcggctcaaggtttatcattcaaaccgtcagacgcattgtcagaggacggctgattgatgccactccggatcacatcgccattgaagagacgcatgaccgtgtattttatatcagaaaccgccatgtggtttccgtcatgcctgattataccgaacgcgtgtaacagcccgaaaaggcgcaaaccggaggcggcactatagaaccccggtgcgtcttcttttttgagatacatagatgcacggcggctttttttggtacaatcacagtacaagttcacacgacaataggaggaaaccgcttgttgaaatcaaaggtccatttttggacgctgcaaattttgctcgttttgctcattatttacgtatcaacgaaagtctcgtttatatttcagccgtttttcggttttatcaccactctgttttttccgattttgatctcgggcattttgtttttcatttttaatccgatcgtgcgcctgcttgagaaaaaaatcccccggacattggcgatcctgctcatttatctcgttttcatcggtctgattgcctttatgttcactgccatcgggccgattgtggcttcccaggtcacggggctgattaacaatttccctgattacattcatcagattcaagtcttgacggcgcaattatcccattccaaatggtttacgtggatgatgacgcaggattatgtgtcgatagaaaaaatccagcagtctctgacgggatttttacaaagccttccgcaaaatattacggcaagcctgtcggccgtgttcggcgtcgttacgaatatcacgcttgtcgtgatcaccgttccgttcattttgttttatatgctgaaggacggccggcggtttccgctcttggcggtcaaaattctgccttcttcctaccgggcggaaggtcggaaaatatttaacgacttatatgtcacattggccgcctatttccaaggccagctgctgatttgtctctttgtcggaacggcatgttttatcggatattggatcatcggcctgccgtatgcgttaattctcgggatggtgatcgccgtcaccaatatcattccgtacctggggccgtttctcggggcggcgcccgcggtgattattgcgtttatggattcgccggctaaggcgctgtttgccgttattgttgtcgttgtcgtccagcagcttgacgggaacctgctttctccgcttgtgattggaaaacggctgaatacccacccgctcaccattattcttctgcttatcggagcgggcagtttcggcggcattctcgcaatgatcctggccgtgccggtttacgcggttttaaaagctttcgtcttaaatatcgtccggcttatcaaacttcgtcagcggtcaaagctcgaagacagccgcaagccgaaataaaaacgggcacaactcccggtgcagcgcataaaatgctgtaaagaaaagcggaggtgtgggtatgcctgcaattgtgggaccgatttatattatgagtttagccggagacgctgcagcgagcttcggtgacgtgtttgccatttctcccaaagccgttgaccactcaggcgcgggggcaggggcgtttcattccggagattttgtcaaaattactaataaattcagcaaaacgcgctttgaagacattgatgtgtttgacgaacctgattggtttaacgcgtgacagcctccttttaggaggctgtcgcttttttgtagtataatagaatcagtctttataaaaggggaatgttttatgaaaatcagaaaagcgaatattaccgtgcagtccggaatgatcggtgatgtatatctgcatgaaaataaaaaagaacagcatacccttgtagccgttccggaacttgagtggagcacgatcatttcctatgaggaagagaaaaaggcgctggcgcagcggcttttacaatcattcagcaagctgattgaagaagaacccgccggagagctcgccggcaagatctcccattgggtggctgaaatgtaacgaaaacggtttaccgcgtcccgtccggggcgataattgtaaaacaagctgggagggacaggccgatgagcgacaaaacggttgacctttatttacagcaggggatgtacggccctttgcagacgaaaccggatgaacgccatttatttttaggctcgctgcgtgaaagagtcatcattgccctgacgaagggacaggtgctgcaaaagcagccgtatgaagaagtgaaacaggcgctgaaaagccgaaaagacgcggtgctctatataaacggaaggctcccgtatcatgcttattcaccatatatgaagcttgccgcacttgccggtgtccgaagctccgtcatctcggaccttcaattcgaaacgccgctcggcctggtttttgccgccgattatgccgtgaaccttgacggcatttacgtgcaggatgacatttttcagcgctcactcctgaaatcttaaaagggcaaaacactgtttgtcattttacaatgccaattcacttacaagtggagataggatataatggttttcatatgaatggcggggaggccggctatgaaaaaagcatttatatgcattgattatacgaatgattttgcagctgagaacggggcattaacctgcggagaacccgcgagacagattgaagatacgattgtcagtttgacgcaagcatttatagaaaacggtgattacgttgtctttgcggtagattcgcatgatgcagacgatgactttcatcccgagacacgcctgtttcctccgcataatatcaacggcacggagggcaaagagctgtacggaaggctatcgcctctttatgagaaacataaacacgcaaaaaacgtaaattatatggaaaaaacgagatattctgcttttgcgggaacggatttagagctgaaactgcgggaacggcagatcactgagctgcatcttgcgggcctgtgcaccgacatctgcgttcttcacacggcggttgacgcctacaacaagggctttcagatcgtcattcatcaaaacgctgtggccagctttaatccggaagggcatgaatgggccctgtcccattttaagaacagcatcggagcgcaagtggcagagtaaggaaggggaaaacaattttggtggagcatggttttaaagacgacagtttgtctttacatacagacctttatcaaattaatatggccgaaacgtactggagagacggcattcatgagaaaaaagcgatttttgagctttttttcagaaagcttccctttgaaaacggctatgcggtatttgcgggcttagaaaaagcaatcgaatacttggagaacttcaaatttaccgacagcgatctgaattatttaaaaacggaattgcactatgctgatgatttcattgattatttacgggatctttcttttaccggatctctttacagcatgaaagaaggcgagctcgtttttaacaatgaaccgattatgcgggtcgaagcacccctgattgaagcgcagctgattgagacggctctgcttaacattgtgaattaccaaacattaatcgccacgaaagcggcccgcattaaaggcgttgtcggtgatgaagacgccctcgaattcggaacgcggcgcgcccatgaaatggatgcggccatgtggggagcgagagcggctttgatcggcggcttcagcgcgacgagtaatgtaagagccggaaagcgttttaatataccggtatccggcacgcacgctcatgcgctcgtacaagcgtaccgcgatgaatatacggcatttaagaaatatgcggagacccacaaagactgcgtatttctcgtagatacgtacgatacgatccgttcaggcatgccgaatgcgattaaagtcgcaaaggaattcggcgaccggatcaacttcatcggcatccgcctggacagcggggacttggcgtacctgtcaaaaaaagcgcgtgaaatgcttgatgaagcgggtttcacagacgcaaaggtcattgcttcaagcgatcttgatgagcacacgatattaaacctgaaatcccaaggagcgaaaatcgatacgtggggcatcggcacgaagctgattaccgcatacgatcagccggctctcggcgcggtttataagcttgtcgccattgaagaggacggcaaactgaccgacaccattaaaatttcgtcaaaccctgaaaaagtgacaacgccgggaagaaagagagtataccggattatcaacaagctgaatcaccactcggaaggtgattatatcgcgctttatgacgagcgggtaaatgatcagaaacgcttaaaaatgttccatcccgtccacacgttcgtcagcaaattcgtcactgacttctatgcgaaagacttgcatgagccgatctttgaaaacggcgttttatgctatgataatcccgaaattaccgacatccagcaatacgtgcaggataacctcaaacttctgtgggaggaatacaaacggatcagcaagccggaagaatatccggtcgatttaagcgaagactgctggagcaacaagatgcagcggattcatgaaatcaaaagcaagctgaaacgggaacttgaatagaaaacaaagcggcctttcctatctctggaaaggcttttttgttgtgataatatttttcacatttagacaaatttcgtcaagttatttgatatacttatgttcgaaggccgcatctaagggggtaaatgaatgaaggtgtttgttgcgagacagcctatcttcaacagaaacgaacaggttgttgcttatgaacttctttaccgggagagcgaagagaaccgttattcggccgcggatggagataaagctacgacggatctcattattaacagctttatcaacatcggaatcgaaaagctgactgaggggaaacgctgctttgtgaattttacagaaagcctgatgttttcagatctccctacctcctttgatcctgaccagcttattatcgaaattcttgaggacataccgatcactccggcgctcatctcaagatgcagacagctgaagaaattaggatatacattagcacttgatgatttttacgccatcaatccggaaaatgaagagttagtggaacagctgatgaaatatattgatattttaaaaatcgactttttgcaatcctcgcgtctggagcgcaaaaaaatcattcagacgtacagctgtaaaagtctgatttatttagcggagaaagtggagacgagaaaagattataaacaggcggccatagacggctttcacctgtttcaaggatattttttcagtgaaccgcgtgtcatcagcggaaatgatctgacgtttcattttcattcttactaccagcttttaagcgaattaaacaatgaccagcctaatatacagcgcgtgacggaatacatagagcgtgacgtcagcttatcgtatcagattctgcgttttttaaacggatcgcaaacaagactgaaaaaaaagatagacagcatccagcaggccatcatgatgctcgggctgaatgagattaagcgcttgatttacattctttcattcagagatttaacggcgaaaagccactcaagccaaaaagaaatcattaagatttccttaatcagggccaaactgtgcgaactgctggcgaaaagaaccggaaggccccagccctcttcttacatgctgatcggcatgttttcgctcatcgatacgcttctccacagggaactggaggatatcatcaaagaactgcctttaatcgatgaagtcggacaggcgctgctcggttatgaaaacgattattataagatgctcgcgctcgtcaaagccattgaatgcaacaactgggactgtgacgagtggggaaaagaactgaacaaagaagaagcgtatgaatgttacttacaggcgatcgaatggtgccggcagctgatcgattgagccgctttaagccgaccatctgagggcgatgataaaccggctttgctctctgatcagactgacacggatgccgtcgggattatacgtcacgtcaaagtcatttttgatgccggtctgcttaatgagccgcttgaccgctgcggtgtcagatgattgcgctgcggtgaggatgctgcgcgcaagctcttttgacgccgacagccgcgcaaggagcaggcgcgcatcctccagcatgcccgcagcttcttttgcggacgctgtcaaaatatctgcgtgaaccggggcactgggcgctggatgccggtatggcgcggcgaaaacagggcagcatggatacacataatgcatacggcggcctccttcctgagaaaacattcgttatacatgagtataggcggcgtgataatgagttatgacatgcaaaaagaccacaatgcgggggttgcggtcttttcggtgtttgtcggtggttatgcgacgctgtttgcccattctgttttgaaattgtgacggcagggactatagtccctgccggtttgtcggaaaaccgttgaaaaaacagcagaaccgccagattggtctgctttatcctaaacgtctgcctttgcggtagttatatagtcctgttcgctaaatgccctgttcgggactatggaattaccttggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaacaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcattttttatccatttcatggataaagtattatacgattgttaaaaaacgaaaaacctgctgtctttcatcacctgcatttagtaaaatagaatgggagggtgaagacaattattgagcaaatgtgtttagatgccgaaacgattaaagagaagatgaaggaaattgtggaggagaaaataaataatccacatttaaaagacacccttcagacttttataaatgaaaaaaatcattttgcttttggtgttcttgcatttaagcattatgtggctttcgatggtgagcattattcggatattacgttattagcttcaggaattgaattgttaattttagcttttgatatttttgacgatatagaggatgaagataacttggataaggaatggatgaagatagatcaatctatctctttaaatgcagccacttctctttattcaataagtcttcaagtgatttgtgagcttaaaacgaactccgattttccccggcttgctatgaaatatgctttaaatgcaatgcaaggtcagcataatgacctcgaaaatttccccgaaactgaagacgaatgtcttcaaatgattaaacaaaaatcaggctcgcttactgcaatgtcagctgtattaggaacaatgcttgcaaatggggagtttaacgaagaaattgagaattattcctataaaattggaattgttaaacagattgaaaatgattattatggtctttttaataaaaatcgtagtgatatcagaaagggaagaaaaacattaattctgttgtatctaaagcgaagatttaatgctgcttcagaaaaaatcttggatttaatgaatgcagaagcaagttaccattcattcctcattgataataaaaaaagccttgaagacctactatttgatgcaggagttagccagtatgtttcaatgttaattaaaatgtacgaggaagaaattacgacaagtataaaagatttaaatataatgttagaactttaatggaggaaattacagtgaagcaagatatcgtacattatcttatggaaaatccacttgtacttacaaagttagcgtgtggggaagctagtttaataggagttccggataaactgttacctgccattgttgagatttttgaaagggacttaagtcaatcaaaaaaatgcaggggaattttttgggaacaatgattgagagagtgagatctattgaaaaaattcattagaaatttttcgattgtattgttattcgtcagtctcttttacgtcgctcatattatatattttactcaaaacggaattttggtaggaacctatgtggttgaaaacaataaccatgaattgcaggttgtaaaactctccaagtctacgtatggtaaatatatgggcttaaaagagggagacaggataattgaaataagcggaaaaacaccgacagaagagaatataagaggtcaatatctagcgaaagctgaacatatgaaaataataaggggtaatagtaaaatagacttacataatactgagtttatttccttaaatagctcttatagtttttttatctatattatcccatgcatattatttgctttaagcatgttatgcattttttatatttataaagttaacagagtaaaagatacttattcagcctttattttgattatttttttattgtgtacatccattgcatatttaagcgcaggtggagtaactagaggatatgaaataaacagatatattaacctttttacatttttgaacgtacctgtattatactttcactttttgtatcaatactttaaagaattaaaattgaaattttcagctggttatgttgtgtctactctctatatattgccggttattaatataataatcgagatattccagaagcattttgccttccaacttgttacgaatattaatttagtaacattttttttggaaatgatggtcgtctatacatccattattttttatggactagtctaccgaaaaaaggatcacttttatttgctgaaagtattacttatatctaataccatagccttttttccgtttacagtattttatattatacctgaggtgttgttcggacagtatatttattctgctatagttacggcaccatttttaataattattccattagctttagtctatcaattcgtggtcaataaaatctacgatatagacttcttgttgggcagaattagatactatggtttcctttccattattccgactattggagttgtatggctgaatatattattcgacagcaaggggaataactttaacattattcaaatcactgtatatgtatttttgatttttttagcggtattttatattaaggagttattagactacaaatttcgcctgaaacgtttttcagaaaaatataattatcaagacagcatatttaaatatacacagcttcttaaaagcgtatcagctttaaaccaagtgtttatgaatcttaaaaagacgatattagatgtgttgcctgtcagtaaggcatatatctttgaaatcagttctgacggagatattctgtattttgataaacagaacagtgaaccgaactggcagccgtataaaaaagaatttgttaaagtctcatcagagattggcaagatttttgaagtaaatcaaggttttctgatgaagattggagaaagaggggcaaactcatacgttctgctttgtttgtcgagcattaatactccgagactgacaagagatgagatatcttggttaaagacattgtctttttatacaagtgtttcgatggaaaacatattgcagatcgaagaactcatgaaccatttacaagacctgaaacaacaaggctcaaacccggtctggctcaaaaagctgatgtttacgatcgaggaaaagcagcgttcggatttggcccgtgatctgcatgattcagtgctgcaggatttgatttctttgaagcgccagtgtgagctgtttctggccgattttaagaaagaggagccttgccagttagaggtgcaggacaagcttcatcagatgaatgagcagatgtcggatgtcattttgatgacccgggagacgtgccatgagcttcggcctcagctgctgtatgatttgggtctggtcaaggcggtatccaagcttgccgcgcagcagcaagagcgtgcgccgtttcatatccgtctgaatacgggccggtttacggcggcgctggatttggatacgcagctgaatttgtaccgcattattcaggaatttctttcgaacgccatgaagcattcacaggcgaatgaggtgctgattatgctgatcagcattcaaaataaagtgattctgcattatgaagacgacggtgtcggctgcaatcaggaagaaggcggcggacagtcgatgagcatgggtctttcgggtattaaggagcgcgtccgtgcgcttgacggacggatgaaaatcgacacaagtgaaggaaacggttttaaagcggatattgaaatggaattgtaaccattttatcaccaaatcgacttggcagaagccaagtctttttaataaaatggaaatgagtgagtaaaagggaggaaaccatgaaaaagatactagtgattgatgatcatccggctgtcatggagggcaccaagacgattctggaaacggacacgaatctttctgtcgattgcctcagtcctgatgccagtgaacaattcgttctccggcatgatttttcagcttacgatctcatattaatggatttaaatctgggtgatgacatcagcggcatcgagctttccaagaaaatcttaaaagagaatcctctctgtaaaatcattgtctacacaggctatgaggttgaagattattttgaagaatccatccgcgcgggcctgcatggcgccatcagcaaaaccgaatctaaagagaaaatcatgcaatacatatatcacgtgctcaacggacagattttagttgatttctcctatttcaaacagctgatgacccagcaaaaaacaaaaacgtcttcttcccctcaaagtgagcaggatcggttaaccccgagagagcgccatattctccaagaggtcgaaaaaggtttgaccaatcaggaaatcgcagatgcgcttcacttaagcaagcggtcgattgaatacagcctgacatccatttttaataagctgaatgtcggctcccgaactgaagcggtgctgatcgccaagtcagataacgtactataaatcttgaagggagaatgacctatgaatctgaacaatacattgctcggcgcactcggtattgaaatcactgaaaacacgccggagagatgcgtggcggtgatgccggtggataagaggacggtgcagcctttcggatatctgcatgggggcgcgtcagcagcgctggcggagactgctgcaagtgtcggggcccagcattttatcgaccggtcgaaacaggcgtgtgtcgggcttgagattaatgccaatcatttaaagtcagtgaaagagggcggaacggtcacggcgatagcggaacccgttcacacaggcagggcaaccattgtgtacgggattaacattttcgatgaacgagaaaggctgatctgtgtttcccgctgtacgctggctgttataacaaaataaacaaacagccggaaccctgaatcgtccggctgtttgtttttacaaatatgaatcttcttttcgtttgatcacaaagtttctgatccctttgtaatcatcctgaacgcttcttttatcaagcgccgctcccgaattgtacgcggccctgcatatgaggtgcgctccgaccggcgccgtcagcaggataaaaatgatgccgagcagtatttttacagaaatttctccggtcagcatccacaagtagcctaacaccccgagcaataccaaattaacgccgagtgtcgagccttttgaagaggcgtgggcgcgcgtatacacatcaggaagcctgagtgtgccgaaagacgcgaccaggcagatcagcgatcccatcagaatacaaacggcgacggcccatttaacgatttcgatcattttcgataatctctcctttctccaaaaacttagcaaaggcaatcgtgccgataaacgataaaatgccgagcagcagaatgatgtccaaaaaggccgatgtgtttaagagaatggatacaagcgcggtcatggcaatcagattaatgccgatcccatcaagcgcgacgacccggtccggtatcgtcggccctttcatgacgcgaatgacgtacagaagagtcgaaaccgccataatgccgagtgataattgcagaataaacgtaaacatcagcggctcacctcctgaatggctttttcaaaagagacgcggatgtcgtggatcgctttctccgcatcttcaatatccatggcgtgtatatagagaatcgaccggtcatcggagatatccatcacgagcgtacccggtgttaaagtgattaacagcgagagcaacgtgatctcccaatcctccgtcaattccgtcttaaacgcgaaaatgcccgggcggatgttcagtttcggcgctataacggttttcagcacgctgacattggccaaatataattcctttataaagatcagcaccagtctgatgactgaccatattttccaaatgtaaaacggccgcgagaagaagcgccggaaaaaaaacagcgccgccaagcctgcgataaatccggttataaaacccgccgtgctgaggctgtttgtgagaaacatccagcaaacagcgagaagaacgtttaataatagttgaaaagccatgccatctactccttcaaaacagcttcaatgtatttttccggattcagcagattctcagccgtctgattgacatacggtgaaacccattcggttccgagcccgaacagaagcgacaaaaggagaaaagcggctgccggataaagaagtccttttgcggaccgtccgcctgcgccggggatttctttttcttcgccccaaaaagccgtcgtaaaaaccttcagcaccgaatagagcacaagcaggcttgatacaagaatcaatacggaaaacaatgtttcccccttatcgaacccgccttccgcgatcttcagcttgcccacaaatccgctgaacggcgggatgccggccaaagatatggctgaaataaagaacatccatcctaaaacgggataacgggtgatcagtccgcccattttatgcaggctggcagtgcctgtcaatgcgataagcgtgccggcaagcataaacagcgctcctttaatcagcatatcgtgaatcaagtaataaaccgctccttgaatggaggccggcgtgttcatggcaatgccgaacaaaatcacgccgacggctgtaataatattgtagatgacgattttcatgacatccgaaaaggcgatagatccgattacgccgaatagcaccgtcagcatcgcaagccacatcatcaattggtgggtaaagcccgtatcgtgaataaagatcagggtgaatactcttaaaatggcatacaggccgactttcgtcaaaagagacccgaataaagccgaaattgcagccggcggggcgtaataagagcccggcatccagaaatacagcgggaatatcccgccctttaaaccgaaaacgacgagaagaaggatgccgatgacggttatcagcccggtctggcccgattcgcttatttttacgcttagatcagccatattcagcgtgcccgtcaccgcatataagtaaccgacaccgatgacaaaaaacgcggatgacacaatgttaaacacgatatacttcaatgattctcttaattgaattttcgttccgccaagcacgatcagcatgtaggacgcgataagcagaagctcaaaaaagacgtacatgttgaacaggtcacccgtcaaaaacgctccgcttacgccagccagaagaaactgcacccctgaataatagaaagcgcgctcccttttttctccgatggagcggaaggagtacagggtgacgagcagcccgattatggcggttgtcaaaacaagcagtgcggcaagctgatccgcggcgagcacaatgccgtacggcgctttccagccgccgagtgtcagcgtctgaatcccgtgtgtgaaaaccgtctgaacgagagcggcgctgatgacgatggagacacaggaagcggcagtgctgaatatccgcatcagcatcacgtgcctgttcataaaaatcagcagcactgcggcaagcagcggcaccagaataggcaatatcacaaagttattcatgttgatcatttcccctcattcgatccatatcgtccgttttcagttcctgataggcgcgaaacgccatcacaagcaggaaggacgtgacgccgaacgaaataacgatcgccgtcagtatgagtgcctgcggcagcggatcgacaaaggacgtgctttttccgcccagtatgggaggagcgccttttttcagtccgcccatggtcaggagcagcaaatggacgccgtggctcaaaagcgcggtgccgataatcacgcgcagcagacttttagaaagcagcaggtaggttgccgccataaacaaaataccggcaatgacagacattaagatttccactattcttcctctccaatcgtttgaataatggtcatcgtcacgccgacaacaacgagatacacacctaaatcaaacaaagtggccgtcgcaagctccgtattcccgagcaccgggagatgaaaatggccgaatgtatgggtgagaaagggcgctccgaataagaacgaacctgcacccgttgcaatcgcgataagcagacccgcgcccgccacataaataaaattgacgggcaaaatcgatttgacggtttttaaatcaaaggccaaaagcagcagcacgatggccgaagacgtaatcagtccgccgacaaatcctccgccgggggcgttatgccccgataaaaataaatagaaagagaaaagcagaatgataaaagatacaagcttcgttgccgtctgaaggatgatgtcgtttgtttttggctgtctcaacgcttttctccctcctctgttacttttgttctgatcatgccgtaaatcccgagtgcggcaatcgacagcaccgtaatttcaaacatcgtgtcaaatcccctgaaatcaacgaggatgacgttgacgatattgtttcctcccccgagcttatggctgtaagcggtgaaaaaggaggagatgctgtcttttgttttttcgctggaagacgcgattccgagcattgtcacgatgacgccgacaccgagagaaatgataaaattcgtcatccggaatgttcttgtcttctttttccgccgcattttcggcagatggtaaaaacaaagaagaaacaaggcgacggatatcgtctcaatgacgagctgcgtgagcgccagatcgggcgctctgaaaatcacgaaaaacagcgcgagtgtgtacccgacaacaccgagtgagataatggccgtcagccgtgatttggcgaacacagtcgcaatcgttgcgttcaccataacgagggacagcacgatttcatacaggccgatctcagccattcctttcgctgtcatggaaaagccgcctttcatgacgaacgccgctccgatgagaatgataaacgacgcaaagatatacagcagataatcccgcaaaaatccggtcatataagatgacgtcagctggtaagatcttttttccatactgcccgtcaccgcatcgtaaagcttgttcagcgtcagttttttcggaaacagaccgtacagacgctcccatttagacagcgttacgtaaccgatcgtgccgacaatgatgatgccgagggtcatcattacctcagccgtcaccccgtgccactgggaaatatggacatggaatgtatctccgccggttaacagagcgggataaatggagttcatcgccggttcaatcaggctgtaagacaaaacgttcggagcaaaaaacagactgacggcgcaagcggcaagaatcaccggcgaaatcagcatgccgagcggagcttcatgcggcgtcttttcaagctgatccgttttgcgcgcgccgctgaacgttctgaaaaacagcttcatgctgtagatgaaagtgaagacgctcccgatccatgcgagaacggggaacagcacgccccacgtatccaggctgaaaatatctgcatgagcaatccgcagcatacttgtaaagaacatttctttacttaaaaagccgttaaacggagggagaccggccatggaaaacgttccgatcagtgaaacggtgaacgttaccggcatgagcgccatcaggccgccgagcctgcggatatcccgcgttcccgtttcatggtcgataatgccggccgccataaataaacttcctttaaaagtagcatggttaattaagtgaaacacagccgcggtgacagccgccgtaaaatactctgaatgctcataatgaagcgcggcggctcctgcgccgagcatcgatacaatcataccgagctgactgactgtggaaaatgccagaatcgcttttaaatcggtttgtttaatcgcattaaaggaagcccataccatcgtgatcagaccgactgaggcaaccgtccaaaaccagacgggtgaaaaagcaaaaaccggactgaatctggcaatcagataaatacccgctttcaccattgtagccgagtgcagataggcgctgacaggagtcggcgcctccatggcatcaggaagccagatataaaacggaaactgcgctgattttgtaaaggcccccaataacaggagaaccatcgccggaataaagaacgggtggcctgcgataatatgcacctggttgaccatttccctgatactgaaagaatccgtcatcagatacagcaggataaagccgccgagcatgcacagcccgccgccgacggtaatcagcagtgatttttccgccccgtagcgtgatttcttccgcttatgccaatacccaattaataagaaggatgacaggcttgtcagctcccagaacatataaagcacgatgacgttatcgacgagcacaacgccgagcatcgcgcccataaacatcagcaggtacacataaaaagggccgagcttttctttgtccttcgataagtaaaaaatactgtaaagcgtcaccaaagagccgatgcccgtaatcaataaagcgaataacagcccgagtccgtcaatataaacggtatagttaataccgagggacggaatccattcggccgcataccggacggtttctccagccattgtgacagggagcttgctgataaagtaaacaaacagcacaacgggcactatcagcacaaaccagcctgtatggacttgttttacccgtttataaagaaagggaacgataaatgcaaataaaaaaggcgccaaaatcgcgaaatgtaacagctgcaacagaagacctcctttgcttgttttttcatcaagcaactgctttatgtaagaatgaatcaatcaattcacggtcataggacccagtacaaattatatcgcacttttttttaccctgctacggcataatgtattcctctttgtgtttttgtggtcttttgaacccaaaataaatttatcaaatatccggatctttgtatatacatttctttttcagatcaagctttacaaaaggagctggtcagatgaagagaaaggcggcggcctgtattggaatattttgttctattattgcaggaacattcatagttgatgatttctgcaaaacgcggcagcagacggaagcagatgattgggagcatttttttctcggtgcggaatacgcagaagacaagctgagtgcggctgaatcaatgcaaacgccgtttcagccgcgtgagtatatcagaatcgtatatagatgaaaagagttccggcaccagggtgcggaactctttttgtgtggcaatcagcgttttcctttaatataagggatgccgttggctttaggcgcatccgcgcggccgatgaagccggcaagcgcgagaatggtcagaatgtaaggagccatcagcatgtatacattcggaatgtctttgaacaggggcaaaagcgagccgataatgctcaaactctgcgcaaacccgaagaacagcgcagccccgagcgcgccgatcggatgccatttgccgaaaaccagcgcggcgagagcgataaagccttgtccggaaatggtggagtgcgtgaaatcaagcgcgatcgtggaagcatacacaccgccgccgagcccgccgaacagcccgctgatcatgacgccgatatagcgcatgccgaacacgttgattcccatcgtatcggccgccatcggatgttccccgacagaacggatgcgaaggccgaacggcgttttgaataaaataaaccaggaaacaaaggccagtacgatggctaaaatcgacgtataatatacgtctgaaaagaaaatctttcctaaaaccggaatatcgcttaacccgggaatgttcgttttgtaaaagggctccgggattttatcagtctgcgcctttccgtaaatcagtttgacgataaacagtgtcgctcctaacgcgagcatattgatcgccacaccggttaccgtctgatcggcgcggaaagaaaccgcggcagccgcgtggatcagtgagaacagtccgccggcaatcatagccgcagccagagcgagccacggagcggcggcgccaagctcgcgtccgaaaaataagttgaacatgacgcttgtaaaggcgccgataatcatcagtccttcaagaccgatgttgacaacccccgatctttcagaaaacacgccgccgagagcggttaaaataagcggagccgcatatacgagtgttgccggaacaataatggataaaatctgcaggaagtccacttacttcgccccctttttcttcaatttatcaaggatgagacggatggcgtagcttgatgccacaaacaaaataataatggcgatgacgatgtcaacgacttcagaaggcaccccggattcaatcggcatatttaatgccccgactttaaggccgccgagaagacatgccgccagaacaacgccgattgccgtgctgccgccgagaagcgcaaccgcaatgccgtcgaagccgacgccggtaaaggcgcccttaaccgccgcatattgaaaggttccgagtccttccatcgcgccggcaagccctgcgaaggccccggaaatcatcatggcgtacatcatattttttctgacgctcattccggcgtattgtgcggcgtgctggttaaagccgacagcccggaattcaaatccgctttttgttttatgaatgataaaccacatgaggactgccgcaaacagagcgatcagaatgccccaatgaaggcgggagtaatctgtcagctgctctaaaaacggcgagcggagcgacgcgctttcatgaattttgtctgttttgtcccggtggtccgtcatgacatcggaaatgagataattggttaaatgaagagcgatataattcatcatgatcgtgacaatcacttcgtggacaaaaaaacgggcttttaaaaatccgggaatcaggccccaaatgccgcccgcagccgcagccgccaataacgaaagcggaaggtggatgtaagcggggcgtcaaaggaaacgccgacccacaccgcggcggtccagccgacaaggagctgtccttcaaccccgatattaaacaggccggtccgaaatgcgaatgccacggccaatccggacagaatatatggcgtaatctgccggatcgattccccgatgtaatacacttcaccgaaaatgccgctccaaagagccgaatacccgcttacgacattgtagccgctggcgagcatgatgaccgcacccgcagctaatccaaggatgatcgcaatcagcggcacagccagatgagaaagtcgattaatcatgtgttttccccgcctccatttgcttacttcccgccattaaaagtccgagctcctgctcgtttgtttcaagcggattgacgtttgcgatgatgctgccttcaaagatgacggcgatgcgatcgctgagattcattatttcatcaagttcaaaagataacagaagcaccgctttaccggcgtcacgctgctcaatgagctttttatggacgaattcaatcgcgccgacatcgagtccccgcgtcggctgggccgcaattaaaagatccggatttctgtccacttcccggccgataatggccttttgctgattccccccggagagagcgcgcgcaggcgtatattcatcaggtgtcctgacatcgtattcttcaatcaggcttcgcgctttgtcataaatcgtgtgtttatttaatatgccgaaagaagagtagggcttttggtaataactttgcagcacgatattttctccgatcggaaaatcaaggacgagcccgtgtttatgtctgtcctgcggaatatgcccgattccggcttcagtgactttcctgggcggcatattttgcagctgtttgccgtttaacatgatcgtgccggcatttgtttttctgagacctgtaatggcttcaattaattcagactggccgtttccgtcaacgcccgcaatgccgacgatttcaccggctctgacagagagggagagctgtttgaccgcctcaacgccgcgcgcgtctttcaccgttacatcagaaagcgaaagcacttcttgtttcggttcagccggctgtttatccgtcttgaatgacacttcgcgtccgaccataaggcttgccagttcatcttgatccgtatgtgcgacatcaagtgttgtaatgccttttcctttccggatgatggtgacacggtcgcagacttccataatctcttttaatttgtgggtgatgaggataattgattttccttcattgacaagatttttcataatctgaatcagttcttgaatttcgtgcggagtcagcaccgcggtcggctcgtcaaaaatgagaatgtcggcgccccggtagagggtctttaatatttccgcccgctgctgcataccgacggagatatcggcaactttggcttcaggatcaatgtgcaggccgtaacggtcggaaatatcacgcacgtcccgggcggcgcgctgtctgtcaattcggccgaaagttttcggctcttttccgagaatgatattttctgagacggtgaaggtatccacaagcataaaatgctggtgcaccatcccgatgccgagatcgttggctttgttcggactgttgatgtgaacgcgttcgccacgcacccggatctcgcctttttccggctgatacaggccgaataaaacgttcatgagtgtcgattttccggcgccgttttcaccgagaagggcgtgtatttcgccttttttcacttgaagcgtgacgtcatcattggcgacgattccgggaaattccttgcgtatattaagcatttcaatgatataatccaccgatttgtcgctccttttcagagatactttgatgagaaagagcttggcaaaagaaaagctgcaagagatgcagcttttccttcaccgctcttttcaaaaaagagaggggataagcacgaaagtctccttatcccctggttcttactcagccttgaaggatttcaattctttttcagttgaagggatcacgagtccgtccgcgattttcttcttccaatcgtctgttgctttgatgacatcgtcagaaaggttctccttgtgatccgagatgccgactgcatcttgcgccaaaccgtatgttaatgttttgccgcccgggaatttaccgtcactcgcttttttcgttaagtcctccacggcagtatccacttttttgaccattgatgtgagagtgacattgtcttttgttcctttgacttggccttccgcgtactggtctttatcgacaccgataacccatacgttccgcttcggatcttcttttttcagatttttcgcttctgtgaagacgcccgttcccgttgcgccggccgcgtgataaatgacgtcaacgcctgatttgtacatgctttcagccgtcgccttgccgacatcggctttgtcaaacccgcccgcatatttcacttcgacggtcgctttcggatttgcggcttgtacacccgcgcggaagccgatttcaaattttttgatcaattcggactccattccgcccacgaatccgacttttcccgttttgctcgatagcgcagcggccgctcccacgaggaatgaaccttcctgttccttaaatgtaaggctcgccacgttgtcttttttgacaacggcgtcaatgatcgcaaaatgtgtgtctttgcgctgatcggcgatttcgctgatggaatcctgcatcagatacccgacgccgtaaatcaggtcaaagtgttcccgcgctaatttatttaagttcgttgtataatctgcatctgattttgattgaagatagtcaaaaccgcttttgccttttttaagcccgttgtcttttccgaatgcctggatgccttcccaggcggactggttaaatgatttgtcatcaacaccgccgatatccgttaccatgccgacggtaaagtttttgctgccggagccgtttgctttgtcacttgaaccgcatgcgcttaatatggttccggccgctgcgatgagcgccatcgccattccgattttgcgttttttcaaagatataacccccctgtaaaatatggctgtgccgttcaattcagacttgagtccccgtgccggatgcagaatcgaaaaaactttctgataataatgatgagacgtctctctttttcccgccttgagcggctgtctcttccgggttcgggacttatgacttatctgaaaagatctgctaaccaatcataatttatcattttacccgccataaataaatagaaatttgcttattttttaaaaaatatcaattttatgaatcggcttcctcatctggttaaaacagaggaggatcagccgggtcattatccttatatagcatatcaaaaaggaatctcaagccttttgtcacgggatatgacagtaaaaaagcaccgttcacagcgaaacggcgctttttgacattataaatattgtttgatgctgctgacattgccggtgttgatatgatattgaaagacgggtctgccgatcgtgccgtacgccatctctacattcagcacttgtatgtcttccagaaatttaaggtatttccggatggagacttgcgagatttcagtatgcttggcgagatcttccgtggtaaaagagccgtcgccgaaagactcaatgctcgcccagatgagtttaagcgtgctctttgtcaatcccttcggaaggtgaaccttttccgccgcttctttcttttgaaaaagctcggcatccaattctttctgtgtcatgcttctgtgtgattgataaactttctgcttgcgtctgtagtcggaaagagcggtttgaaagcggtcaaattcaaatggtttgattaaataatcgacggcgccgtaccgaagcgtttttttaatgacgtccagctcgcttgcggccgaaatgacgatgacatcaaccgattcattctgcttgcggatttccgttaaaagctcaagcccgttttttcccggcatgtaaatgtcaagaaggatgagatcgatatgatgctcgctcagcacgtgcagcgcgctttgaaaggatgatgcgatccctttcagctgaaatccttcaatctggctgagatagcgcttatttaattcacccaccatggggtcgtcttcaactatgagtacattaatcatcattttcctccttcggttcatacggaatgcgaagactgaaagtcgttccttcattcttttcacttgtcacaatcatatggccttttaaattttctgttgcctgctgggtgaaatagaggccgaacccccggtttgtccctttcgtggaataaccttgttcaaaaatacgggcttggtctgccgcagacattccggctcccgtgtccgtaatctctatgtcaagctggcgatcctgaaaccgcatcgagcacgtaatgttttttttcggcatctgcgccaccgcgtcgagcgcgttgtttaacaggtttccgataatcgtaatgagctcatggatgacggccggatccgccgcattcggaatcaggctgccgagctgaatgtccagatcagcgccctgctcgcgtatgtagctttgttttcccagaagaaaccctgcgagaaccggacttttgacatcacttataatctcgcttgtttccgtcttctgctgaatggcaatgtctttaatgtaagtgccgagatcatcgtattcttttaactggacaagccctaaaatgacatgaagcttattcatgaattcgtgagactgggctcttaatgcgtttgcatacattttaacaccggacagctgttctgctaaatgtttgacctccgttttgtccctgaacgtggcgatcgctccgacggtttgtcctttcagatgaatcggaacttcattaaagaccagctcaagtccgttaatgcggatatctctgtcctgaagcggttttttcgtttcaatcacctgtttcagccggcttttcgggagaatatcgttcacatcttgatcgaccggattagtcggaatacccattttaataaaaagtcgtttcgcctctgcattggcaagcttaatttttccccgcgcgtcaaccgcaaggatgccttccttcgttgattcgagcatggcgctccgctcttccaggagggtggcgatttcataaggctcaagaccgtacataatgtttttgacggtgcgggcgacaatgacggctccgatgacgccgacaaaaatacttacgcagatgatgaaataaagcggtctcaaactgtggctgacgacatcctgtattttgttaagcgaaattccgaccgaaacgacgcccacttgttttttatcttttccatagatcggtacgaaggctctcatggattttccgagagttcccgctgatgtgctcgttttgatatggccgtgcaacgccggctgttcgtctccgccggtgaatttcttcccgattttatttgcgtcggggtgggtgaggcggatgctgttcatatccatcaccacgacaaattcggttcctgtcgtatgctggacatccagtgtataattccggagctctttcagcccttttcttgtttgcaatgcctgcgcgacactcggtgtttccgcgacaagctttgcggtgcgcagcgcggttgtccgttcttcttctttcacgcggtccgcggtctggacgctgatcgtgaaaaaggtgatacaaagtgcgataaggacgacaatacagacgaatatcgttaaccgggtttgcaattttaatgtttttttcataacagccttccttacgtttatcattcccgcgttctactttactccgaaaaagccggtttgtgaagatcaggcccttatttcgtaaaagtgaggaaaaatggaattttttatcttgtcaatgtgttttaagtcctccataataagtgaggtagattacagaaagggactttttatatgaaaaatacttattggacgggttattttccgctcgttgcgattctgctttttagttcgtcattatccatttctacctcgctttatgtcatgaagatacttcagacgctcggcatgtatcaggggatgctggattatttctctgagaaagggatcagactggcgctttttgcagcgttcgcccttgtgtattttatgcttttttcggctttgaagctgattgcaaacacagtgacagagctgtctcttttgtttttcacaaatgaccctgagggggacaatctgaaaaaaatcagattaggctctttaatttatgtaggcggaggaattctttcctttgcgttcgtgcagaatggtttttggattgcggcgttatttgccgttgttacgctcatttatttgattttcatggtgtacagaatctattcgacactctcgatcgtttcgctgatcggttttatattgcttgagattctgttttggtttacttttgttatcggtattttgtacatctttatcaagctttataatagcataatggctagcttacctgtgtaagctagccatttttgttaagacagaaatctgtttttgatctcaggggaggggagcatgcatgcttccctttttccgaaccatttgtaacggcgccgggcgatgaaagaataggctctgtccctgaggggcggggcactgcgaaaaaaaccgctgacagccgccaggctccgcggagatgacgcgaaacctttaacacggctgcggattttttgtatatccgcccgttttcgataaaaatcatgctgtcaaattgttctgtcggaagtccttctgatgccaaaagctcccgggcggtatctgattgcaatgaagcaaatgagattttgccggccggatcgcgtttaatgatgaattgaacggcgccgctgcataagttgcagacgccgtcaaacaaaagcacgcggtccggaagctgagctggtttcaaagcggatcccctccgttatctttaataagctgcctgcagcgtgtttttccagatcgaaagctgagggcttgcgtcatgaaggtattcgacgcttgacggtgtatccttgccgacccataccccatcgtataagcgtccgtcaggccgacaaaccacatatcgtgatagtcatttgacgttcctgattttccgccgacgtacggagctttaaagttcgctttttttcctgttccgcttttgacgacggctttcatcatttctttgatctgcatgttggtccgcacgctgaatacctgcgccggctcatctttccattttaatatcgtttttccttttaaatcagtcacttttgtaatcgcgtgactcggcgtataaacgccgttgttgccgaacgtggtgtacgcattggtcatttcaagcggcgtcatgccgtttgtaaaaccgcccagcgccgcaggcaggcggtaatccgcgctgaccagcttcgcgaaatgaaacggttcaaggtagctgaacgccttattgacgccgacgcggtccatgattctgatggccggtgtgttgtacgagtatttaaacgccgtttccagcgtaaccgtgccgtatgtgcggttattatagttctgcgggcagtaatccgcactgcagaatttgcttgcgtcaattttgctgtgtggcgttgcgccggtcttttcaatgtaaggtccgtaatcaagcagcggcttaatggatgaaccgggctgtctgtatgcttgataggcgcggttgaaatcatatttatgataatctttcccgcctgaaagcgcgataatctgatgtgtctgatgattaatcacggccgctccgccctggacgcctgcatacggcagattttgattcacttgggcgacgacctggttttgcatatacggattcagcgccgtataaatcttcacgccgtcttttaacaatgtgctgactctgtcggaaagctcactctgtattttttgtttcgcctttccggaagctttttcaagacgtttgtcatagccttcggatgaggaaacaagctgtgtgaattcatcatttacataggaaacatagtcaggatatttatttgttttttcgtttatatcaagcttgatcttttccttttcggcttttttcagctgtttcccggatataacgcctgcttttttcaatccgttaagcaatctgacttgtcgttttttcgtataatcaaaatgcttgagaggatcatataatgtagggttattagggatggcgcagataaaggccatctctcccaaagtgagagatttcagcggcttgctgaaataaaattgtgccgccgaaccgacaccgtatacaccgttattaaaataaatcgtatttaagtagccttctaaaatctcatctttgctgtattttttctcaagctgataggaataggccagctccgtcagttttcggctgaaggtgcgttcatggcttaaatacacattccttgccagctgctgggtgatggtgctggcgccctggtcaattttatgatctttgaaattggaggcggccgccctgaccatccccataaagtcaaaccctttatgctcataaaaatggcggtcttcagaggttaaaaacagctgttttacctcattcggtattttattaaagggcacgatcacgcggttctcatgatcgctgacaatctcagaaacaaggcttccgtccctgtcatacatgtaactgttttgaaccaggttgatcgcttttaaatcaatatgtttatcgagcacctgatcaaaaggcttgatttgttttacctctttgccggaagcaataactgtaaatgcacacaacgggataatgccgagcagcaaaatccatccgattattttacgtaccatggtcactctcttttctcctgatttctagccatatcgtatcattcttttaagaatacgagaaggttaaatttagaagaaatcgtgatcgctgccggtcagcccgcatttgacgctgtatccttttgcagatgtcccgccatccataaaagccccgcgcctataaaaaagagaaaggcggtgacgtagaaagcagccgaaatagaaaaaccgcttgagaccgcacctccgagcagagggccgagcacgtttccgagaaaacgaaagctgacgttatatccgagcacctctccctggatgctgcccggagccctgacgcggatcgcggccgtaatgcaggggagcgtgccgcccatgaccatgccgaacagaaatctgaagactaacagaatggagagggaggaggcgagcgcctgcggaataaaaaacaccgctgatgcaatcaaaagcacgattaagatccggctgtggccgaagcggtcgccgaagtcccccatttccgggcaagcaataagcttccgagtccggtcgctgaaaacgccattccggagaaaaaggctaaattaacaggtccgtgcagctcattgacatataaagcgagcagcggctggatgctgaaattgccggtctgcacgatcatggtaagcaccatcatcgcccaaagcgcgggctggtgaaaaatataggagagcacctgttttctggaataggttttccgcttgttttgtttctcgccgagcggctgctcattcacctgaaataaaacgagaagcacagatgcgaaaatgacaaaagacgtaataaaaaatgtgtacgtaaatccgaagctgtcagcgagcagcccgcccagcatcggtccgaataaagtgcctgacacctgacccatctgcagcgtgccgagcgttttcccggcagtctctttcggcgtctgcgccgaaatcatggcaagcgaagtcggaacaaagcccgttacaaggcccataagcagccggaggacaaacagctgataaacggatgtcacaaaccccatcaataaaatgctgacggcaatgccggtgcctgtgatcaagagaatttttttgtagccgcgcttatcgccgaatctgccccaaaacggggaaatcacaaacgccattaaaaacgtgacgccgaacacatacccgctccatctctgcacatacccgcccgaatgggggctgatcgtttcgatatataacgaaagaaacggaacaatcatggtcatgctggcggaaataaagaaatttgtaatccaaatgacgacgaagttcttcttacggacagaaataacatcaccttctttaattttcgtgtgtctaatcattagtatataggaatgaatccggtatttgtattttcgatgcggatataggaaaattcattatttttagaaaatgaagaaagtttcagaggggaaactgatatactatcataaaatatcatttttgatcggaggaaaggcaggtgtaaaaaagtggatcagcgcagtctgctcattattgattttgaatttacgatgcctgacggaaaatacagcccgcaaaatttctttcccgagattattgaagcggggattgtcaagacggtgaatgatgaagtgactgaaacgttttcgagttatatcaaaccgaaaaaatttccaaagctgacgaaacgatgcaaaacctttctgaacatcacccaaaaagacgtggacggcggaatcacgtttaatgaattcatccgcaaattaaatgagcttgatcctgataaaaactgcacgatcgtcacctggggcaatatggatatgaaagtgttaaagcaaaattgcatgtttaaccacatcccttttccgttcaaaggagaacttcgggatctgtccctagaatataaaaacttctttggcgacagaacattgaccggcctttggaaagcggcggaagagtatggcgataaagggacgggcacgcatcataaagcgctggatgatgcgcggacgacatacaaattattcaagcttgtcgagcgggataaacaatatcttgaaaaaccgaaacccccgacgatcggtgatcgcgtcgatctgactgaactgtttcgacgggccacataaaaaaacccaatcatgccgactgggtcaagttcttttaaaatagtcacgctctaacgcggccaagttggcgagcgaacgttccgcccattctgagccgtccgctgtaagctgatctttcagccgggcagacgccgcttgtaaggaagccgtataatcaggaacttcgccatcaaacggtttgaccatctgatgcggtatgtttgtctgttccccgaatgcaagcgctcttctttcatgaaagaacggaacatccgcctgcttcggatgatgaagatctccttgagcgggatgcgtcagaacggctttaattttcactaaatagtgattgggcctgacgtctgtcacttcccctatgtatgctcctgttttataaaacccttttacgattgtgccgatttcaaacgaattcatagcgttcacctctctctagttattctataaaagatcaacgcgattggctagtgaacagctgccggaagcctgactgaagccgttgtgcccgagtgctcgccgctggtgaaatagacggagccttcatgatgctgaataatcgagaatgtcacggtaagcccgagcccggtgccattcgttttcagcgtataatacggtttgccgagtttctgcagttcttcatcggacatgccgattccgttatccgtaatctgaatgagaatcatctcttcctgtttttggacggagacctcgattcggccgttttcagagggcacggcttcaatactgtttttaatcagattaatgaaggcctgtttcagtttttttacatcgccgaacacatataaatcaggctcgctttgaacagtcacggtcaccgatttaaaattagcataagactccattaaggaacctgtttcctttacaagcagagaaatatcaaacttttctttttcatagtcatcctgcttcgccatatcgagataattcgtaatgatcgtctgagcccggtcgagttcggacagcacaagtttctgatatccggagtgggatttgtcctgaagctgctcgccgctgaacagcagctgcacaaaacctctgacgaccgtaagcggattgcggacttcatgggcgacgcttgccgcaagctcgctgacgacggccattttttctgagtgaatcagccttgcccgcatggacgcattctcatcaatgatctcaatcaaataaatgcacagcaaaagggcgctgacttgaaaaaaaacggatactgccgcctcataataaacggaagatagattttgaaaattgaaaatattggtcgcggaatagatgaagacagatgcggttaataaggcggtttcagtgcagccgatgagaagagcgaaaagcagtttcttccgctttgagaaaaaaggccatttcgtttggagctggatagggatgatgattaaaaaaggaattaaggataagaaaaaaagagcggaaggttcaaaccatatgagctgaaaaaaaacggatgctgcccctgcggcaagtcctgctgcggtaccggaataaagcaggcagacgataatgggaatcagctgcaaaccgtaacggacggaatgaagctcctggatgggaaaagccgtacataataaggaagatgacgctgcaaatacggcgaccagcaggcggttcgctctcggcacaagcaaatcgggcttgctgagccagaagacttgatagagaaaaatagggaataaaataaaagagaagtgaagcaggtaatcctttacaatctccatttatgcgaaatcctttcctatgtaaatatgaatctattataacatctttaccggcaaaaaaagtatttatttctctaaagcgaacgcccttatctcatctgataaaggcgttctttccgctgctaagagagcgctgctttcattctcttaagcccttcttttacggcggcggctgaacagccgacattaagtctcataaatccttcgccgcccggtccgtatttcgttcccggctctaatatgattttcccttttttgagcattctttctttgagctcggcatccgaaaatccgtatccgctgaaatccatccagatcaaataggaagcgtcaggtttcatcatgcggactttcggcaattcttttcttaaaaagtcctcagccaatttcatattcctttcaatgtaaggaatcagtgcgtcaagccaagggcctccctttgtataagccgcttcgattgctgcaaccgcaaatgtgttgaggctggaaatcccgttctgatgcaatgcggcggagaatttcgcccgcttataacggtcgggaatgataatggcggatgcctgaatgccggcaatattaaacgtcttgctcggcgcgacacaagtaatggaaatccgcgcaaactcctcagacagagaagcaaaaggcgtatgcggctttccgtacagcatcaagtcggaatgtatctcgtcagaaacgacggtgacgttatgagcggcgcacagcgatccgagctgcataagctcatcccggctccacgctctgccggacggattgtggggattacaaagaatcatcagcttgacctcagaatcgctcagctttttctcaagatcctcaaaatccatgcagtagacgccgttctcttcccgtaatgggttatgtaaaacctgccgtttgttttccttgatcatctgataaaaaggcgtatacaccggtgattgaatcaacaccggatcgcccggttcggtaaaggcttgtactgccatgctgattgccgtgacaaccccgggactgaacgtgatgcttgcgggatcgggccggtagccgtgccgtgtctcaagccatgaagcgacggcttctcttgtgttttcgtcaggagacgtataaccgaatatgccgtggtcaaggcgggcttttaaggcgtcagtgaccgcttcgggagcgcggaaatccatatcggcaacccacatcggaagtgcatccgatacgccgaataacgcttccgccttgtcccatttcaccgattgtgtgccaagacggttttctcgaagatcaaagttcatgtatgtcactcctgtagtatcattattttgcacagcgtatctatgataaaatagatttgcaaactttattataagcggtgatgaaaatggaagaaagccaagcggtcatggaaatgatgaaaatcattgccaagtgggacccatttaaatatggagaagatttttatgagacagaagccgtcgacatcgttcaggccgtctacagtgaagaccgtgccgacaagctggcagcagccattcaggatatctttgaagcttcatttgagcaaaagctaccgatcgaaggctgccaaaaggccgccgagcagcttctgttcataaaagaaagcagctcctgcaccccttaaaaaccggcggttccgccggttttttttattgaataaattcaaaaatccgttccgaaacaaactccgggcgctcttcgggtacgaggtgtcccgtatccttgagtgaatacagaatggaatccggcaggtcgtcatgaagccgttttccgactgagaccggaacgacccggtcttcttctccccatattaaaagagcggggttttgcactttcttcaaatcctcgggctctaaatcgccctccctgtgtctgatgaaccttgtcatcgctttgaaaatctggcggtctgtaaatggtttttcgtaaccgtcaatcatttcctgatcgataagcgtccggtcgtgaacgacatttaacaggtttttcagcacaccgtcttttgaaagccaatacttaagatacaggtcaaaacaagggaggtgcgtcccgaatataatcgacgggtgcgagcgctttaaataccccgagctgcacagcaggacgattttagaaaaaagctcgggtctgagaagagacgcggataaggaaatctggccgcccatcgaatggccgatgagtgcggcccggctgataccgagcttttccagaagtccgatcagaagcttggcgaggtttgcgtaagtatatacgaaagtccgtgacttttccgattgcccgaaaggaggcaggtcaacggcgataatatcataatggtttctgagcagcgggatcagttttctgaagctgaatgccgaagataaaaaaccgtgtacgcagacgagtgtctgtctgccgggattttcataatgctcgtaatacagttcaactccgtctatcgcggcccgtttaatcggtgaaacagcttccatgagagccttcgccgtcctttctttgttgtaatgtaaaggcttttttgattgtcagattttagttctggtttctttcgggtttttcttagcatttgtcgaaaatcgtgatataatgtcatgaagatttttgataatgcaaaggtgtgaaacgtatgaagctgacggaaaaagaaacagaaatattagaaattttagacgaaaacagccgcgttgatgcggaaacgatcgcgaaaatggcgaacattcccgccgaagaagtcaaaagcatcattgaaaagcttgaaaaggaaaaagtcatcattgattatgcggcgatgatcgactggcgcaaagtcgacggtttggaaggcgtcacggcgatgattgacgtaaaagtcactccgaaacgaaatgtcggctttgatgaagtcgctgaacggatatacagattccaggaagttgaatcagtgtacctgatgtcaggggtgtatgacttatctgtcgttattcgcggcaacacgatgtcagacgtggcaagcttcgtgtctgaaaaattgtccacccttgagtccgtcgtttccacgacgacgcactttatcctgaaaaaatataagcatgacggcaaagtctttgaaagcggagacgatgacaaaagaatcgtggtgtctccgtaaatggaaacgaagacttcttatttatctgactacgtgcagcagattaaaccgtcaggcatccgcaaattctttgatctggctgctacgatggaaggcgtcatttcactgggagtgggagagcctgactttgtgacggcctggaacgtgagggaagcgagtattctttctttagaacagggttatacggcttatacggcaaatgcgggtctttatgaactgagagaagaaatcagccgctatttagatcagcggttcggcctgagttattcgcctgacagtgaactgattgttacggtaggggcaagccaggcgcttgatctcgctgtccgcgccattatgaatcccggagaggaaatgttaattcccgaaccgtgttttgtcgcatatgaatcactcgtgaccctgacgggggcgaagccggtgccgattcagactgtagctgcaaaaggtttcaaagcatcagcagccgattttgaagcggccctgacggacaaaacaaaagcgctgcttctatgctcgccgtcaaatccgactggttccgtctattcgaaagaagagcttgaatccatcgcttccttcgctgaaaaacatgacttgatcgtgcttgccgatgaaatttatgccgagctgacgtatgatgagccattcacgagcatgggagccatccgcggcatgaaggaacgcacgattttgatttcaggtttctccaaagcgtttgccatgacggggtggagactcgggtttacggcggcgcctcccgtgatcagggatgccatgctcaaaattcatcagcacgcgatgatgtgcgcgccttccatggctcagtacgcggcgcttgaagggctgaaaaacggtcaggaagacgtcgaaagaatgaaaaaaagctaccggagacgccgaaacctgattgtggaaacattgaacgaaatcggactcggctgccaccaccccggcggagcgttttacgcctttccttccattcagtcgaccggcatgagttcagaagaattcgcggaacagctgctcattgaagaaaaagtagccgtcgttccggggaatgtattcggcccgagcggcgaaggctacatcagatgttcctatgcgacatccattgagcagattcaggaagcgctcgtcagaatcaaacggtttgttgaaaaaagggcataaaaaaagatacgaacccggttcgcatccaaataaaaggggggaatactagaaagccttcgtaatcatagtataccccctttatctgcgcttaaacatgatgatgtaaaaaagttctctttgcgaaaaacaaacttgtatgatataattttaaattgcgtataatctgtatttaatttaacttaggagttgttatgaatggcagcaaaatttgaagtgggcagtgtttacactggtaaagtaacaggattacaagcgtatggtgcgtttgttgcattagatgaagaaactcaaggacttgttcacatttctgaagtcactcacggtttcgtaaaagacattaatgaacacctttctatcggtgacgaagtacaagtaaaagtacttgcagttgacgaagaaaaaggcaaaatcagcctttctatccgtgcgactcaagcggcgcctgaaagaaaagaaagcaaaccaagaaaaccgaaagcggcacaagtttctgaagaaacatctgctccgcaaggtttcaacacattgaaagataagcttgaagagtggattgaacagtccaaccgcaaagaccttatcaaaaaataaccatcaaaaaaagcaccggatatgtatgttcggtgctttttttatgtttatctgacttccggatttgccgcttcctcgcgggatgtttcttcgttcggcttaaacagcaggccgagattgatcagaccggcgatgccgacaagaccgtaaataatccgcgacagagctgatccttggccgccgaagatggctgctactaaatcaaattggaaaaatccgatcagtccccagttaatagcgccgataatcgttaatacgagacagatacgctgaataacactcatgtaaacaacctcctctataaattcgtgaaacagttatagattgtgacaaagcaaagaatctatgcatactacattctccgccgtgtaaatcacacactgtctcaagctgtacaagtgcctttcccgggaaaccgctgtctgtaaaccgtgtgatgtgccgtcaaaaaagcggattgctttacattgaacgtcaactttctgcataatataaatccaaaggaggagatgtcatgcaaaactttacatattggaatccgaccaaattgattttcggaaagggagaggtcgaaaaacttcctgaagaaatcaagccgtacggaaagaacgtactgctcgtatacggaggcggcagcattaagcgcagcggtctttatgatcaagtaaccgacctgctgaaaaaagcaggagttaccgtacatgaattggcaggcgtagagccgaatccgcgtgtctcaacggtgaacaaaggtgttgcgatctgtaaagaaaacagcatcgatttcttattggccgtcggcggcggaagtgtcattgactgcacgaaagccatcgcggcgggcgctaaatatgacggcgacgcgtgggatatcgtcacgaaaaaacaccagccgaaagaagcgctgccgttcggaacagtgctgacacttgcggcgaccggttcagagatgaactccggatcagtcatcacaaactgggagacacaagagaaatacggatgggggagcccgctcgtttaccctaaattctctattctcgatccggtaaacacatttaccgttccgaaagaccacaccatttacggcatggtcgatatgatgagccatgtgtttgaacaatatttccaccacacgtcaaacacgccgtatcaggaccggatgtgtgaatcgcttctgcgcacggtgattgaaacagcgccgaagctgatcaacgatctggagaactatgagcttcgtgagacgattttatatacaggcacgatcgcattaaacggaatgctgtcaatgggcgcaagaggggattgggccacacacaacatcgagcatgcggtatcagcggtatacgatataccgcacgccggaggtttagcgattctgttcccgaactggatgagacatgtgctcaaagaaaatccggcccgctttaaacagcttgccgtccgtgttttcgatattgacgagacaggcaaatcagatgaagagatcgcacttgaaggaatcagcaggctgtctgaattctggacgagcctcggcgctccgaacagactcgctgattacgatatttctgatgagaagctggatacgattgcagataaagcgatggcaaacggagcattcggacagttcaagtcactgcagaaagaagatgtgcttgcgatactgaaagcatcattgtaataacataaaggggggcggccggattggcagctcctttttttctgtgttatagtaattcccttacgatttttttggaggtcatgataaatggagaactttacgtactgcaatccgacgaaactgattttcggaaaaggtcaaatcgaccaattgaaaaaagagctgaagcaatacgggaaaaacgtgctgcttgtttacggaggcggcagcattaagcgaaacggcctgtatgaccaagtaacaggcattttaaaagaagaaggcgcagccgttcatgaacttgcgggcgttgaaccgaacccgcgtctggaaacggtaaataaaggaattgagctgtgcagacagcatgagattgatttccttctcgcagtcggcggcggaagtgtcatcgactgtacaaaagcgattgcggccggtgcgaaatatgacggcgacgcatgggacatttacagcaaaaaagtaacggcgcaggacgcgctcccgttcggcacggtgctgacgcttgcggcgacaggctctgaaatgaaccctgattccgttatcacaaattgggaaacaaacgaaaaattcgtatggggcagcaatgtcactcatccgcgtttctccattttagatcccgagaatactttcagcgttccggaaaaccaaaccgtatacggcatggtggatatgatgagccacgtatttgaacaatacttccacaatgttgaaaacacgccgcttcaggacagaatgtgttttgcggtccttcagacggtaattgaaacagcgccgaaacttttggaagaccttgagaactataagcaccgcgaaacgattttatacgcgggtacgatcgcattaaacggcacgctgcaaatgggctatttcggcgattgggcttcccatacgatggagcacgccgtatcagcggtttatgacatccctcacgcgggaggacttgcgattctgttcccgaactggatgagatacacgcttgatacaaatgtggaccgttttaaaaacctcatgcttaatatgtttgacattgatactgaaggcaaaacggataaagaaattgcgcttgaagggatcgataaattgtccgcgttctggacaagcctcggcgcaccgtcccgccttgcggattatgacatcggcgaagacaagcttgagctgatcgcagacatcgccgcaaaagaaatggaatacggcggattcggcaatttccaaaaactgaacaaagatgatgtacttgccatcttaaaggcgtcactgtaagatacattcccggccggagtgattttcaagctgcagatgtaaccgttttgggagtccctctttccggattttctattagttcattaggagcaagtgaaacacccttttccatgagacaactatggaaatcgtttcatccgtaaaggaccaattaactttgcgattgtctgtcatctatttacacgaaatctaaatcacgaagatgaagagccgcgaatttaaaaaaggggcgctgattcaatcagcgctcctttttatgcattttgtgtactaaggtcccgctgcgcccccatatagcttcccattaagttttgataaccgggaagatgactggagactaatgcgccaaaaccttcaacatcgttgcgccaatcacgctgaagctcgcatgctgtgctgaaccagttcataagctgcacgccgccatgagccatacgggttaatgatgcatctgctacttgcttattaaacgtccccgaagcatctgtcacaacaaacacttcgtagcctgctttaatggcagaaagcgcaggaaaagcaacgcagacgtctgttaccacccccgcgataatcagctgttttttgccggtcgcttcaatggctttaacaaagtcttcattgtcccatgcattaatttgtccgggacgggctatttttggcgcatcaggaaagagatcaacgagttcttgcatgagcggtccgttgggtccattttcaaagctggttgttaaaataaccggtaaatcaaagaatttagccgtatcaccgagagccaatacattgtttttaaattcatcaacgccatagtcacgcacgagaccggaaataaggccggtttgatggtcaactaaaagcacggcagaatcatcttttgaaagacgggaataaagatcagacattttatcatcctccttgaattaaggcaagtcagtttgtcaatggaaaacggtaaatctattcatatactgtataggtagaaagttatttctgaagtgacttttcgtgaaggtgatgatctttcaattaatccggaatgggaaccggagcatgatcaatccaatggatgaactgttgtaaatagcgttgaagataacgttttgtttgttcatccgtaagtatgtgttgagcggaatcaattttctcatggacttgcgaaatcagcattttttgaaagggcagaacattgacttgcatagcttcgagtacttctctcgtttgcatttgaccaaaagaggtgccgaaccctccgggggttgcgccgattaagccaaccggttttctgtttaaaacggaagaggtccgcggtcacgatgcccagtccaatgcattttttaatacccccgggattccggaattgtactctggacttacaatgatgacgccgtcaacgtctcgtatatcagctctaaaggatgttacggagtctggtgctccggccatttctaaatcttcgttaaaaaaaggaagagtgtctatttcaacccagcgaaattgagccgcattatcgaagtcaatcaatgattgagcaatcactcgattatacgagttttttcgtaaacttccacaaataagaccaatggttttagtcaaagaatcacctcccggtttaaaattattttcatcttaacatgataacccaaatatagacactatttttaaaaatggacatttataccttaatatgcctgcttagcagcctctcaagaggagtactatataaaaagaaccgtcccatcggtattggcgatggatgtcaacctgctccaaagtaaaggtgatacgttcctggatcaccaacattcgattcgttacctctttcacgattattacaaatataactatttcgaatccgggatattgtataaaaaatgagcgcatcttcagcgcaaatcccgtattcatcatgccttcttcatgacttgatttagcgggtgagttcatataaagtgaaagagaaaacaattcaccgtgatggagggacaagcaaatgacgcatgtacgctttgattactcaagagcgttaccttttttcaatgaacatgaacttacatacgcacgtgatttcgtaaaaacggcacaccataatatccatgaaaaaacaggcgccggaagcgactttttaggctgggtggacctccctgaaaactatgataaagaagaattcgcgcgcattaaaaaaagcgctgaaaaaatcaaatcagattctgacgtgcttctcgtcgtgggtatcggcggttcatacttaggcgcccgcgcggcgattgaagcgctcaatcattctttctataatgttctgccgaaagataagcgcaaaaaccctcaagttatctttatcggcaataatatcagctcaacttatatgaaagatgttatggatcttttggaagacgctgatttctctatcaatgtcatttctaagtcaggcacgacgacggaacctgcaatcgctttccggattttccgcaaacttcttgaagaaaaatacggaaaagaagaagcgaaagcgcggatttacgcgacaacagataaagaacgcggcgctttaaaaacgctttctaatgaagaaggcttcgaatcattcgttattcctgatgatgtcggcggacgtttctccgttctgactgcggtaggccttctgccgattgcggtaagcggggctgatatcgatgaaatgatgaaaggcgctcttgatgcaagcaaagacttttccagctcggaattagaagagaacgcggcttaccaatacgccgtcgtccgcaacgttctgtataataaaggcagaaccattgaaatgctcatcaactatgagcctgcgctgcaatactttgctgaatggtggaagcagctcttcggcgaaagtgaaggaaaagacgaaaaaggcatctatccttcttccgctaacttctcaacagaccttcactctctcggtcaatacgtgcaggaaggcagacgtgatctgtttgaaaccgtattaaacgttgaaaaaccgaagcatgagctgacaattgaagaagcggaaaatgatctcgacggcttaaattatttagccggcaaaacggtcgatttcgtcaacaaaaaagcgttcgaaggcacgatgcttgcccatacagacggaaaagtgcctaacttaattgtcaatattccggagcttaacgcatatacatttggatatctcgtttatttctttgaaaaagcggtggcgatgagcggttatctgctcggagtcaacccgtttgatcagccgggtgttgaagcctataaggtgaatatgttcgcgcttctcggcaaaccgggctttgaagagaaaaaagcagagcttgaaaaacgccttgaaaaataaaaagaagggctggccctcagcatgacgggtcagccttttttaaaccgtgaaaggtgtgatgatgaattgatgcggcttttatgtaagcatgtcttcatttccgtctgttccgccgctatcgtctattcggcactaaaactgtctcccgaatccctcttgcaaaccatcctgtttttcgctttccctctcggcttgtttacggacatggtccggctgaaactgaagattggccggatgcatacgctgatcacgaagtgctgtctctatgccgccgttttctatatttcaacggaagccgctctctccgcaattgtgacgtatgttctgattgaatgcgccgtcacctcttttcagcgtctgtctgccgctcccggttcttcccggacgccgtatgaagataccgcagagcggggacgctaaagacaaaaaggagcatatgcacatgatcagcataccatcttcacttgaaggtcaatcgtttttactccgcgaactggaacaggtgatgaaaccgatcggttataccatcggaggcggctgggagtatgaccgcgggttctttgattacaaaatttccgatcaggacggctatttatttctccgtatccctgttgaagcaaataagggacacctggatgaacggggggccgccgttacaatcggcacaccctttttgctgaggcacgtttatcagcaggaaacggatgatgcagcaggcggcggtgtttttgagtcattattcaaccaattctccgaaccgaaacggcgggatgcggcaattgaccgctcatatacagatatcggcatctcgcttgtgaaagagctggaagacgtcctgctgcattaaagagccaaaaacagatcagtatcgagcacctggtatgacaggggaggggtcagcatcggcccctcttctttttgtatgccgatgatcgtggtattccgtctgagataatagagcgcgcagtcatgataagatgagccctttagttcctcggggacgggaatgatgcgcacctttttctccagcgtcagatctgacagcgtttgcggtttggcaagctgcagcttgacccggtaatgctcaaacatcacccggctcgacaggtgtgatgtgcacagaatcttattggctcctgcgcgctcggcgtttttgacataccgttccgttaaaatttctacgatacaataaacagacggatgcagccctttgatggcgagaagcgttaataccgacagcatatcagcttcggattcatttttctgctggtccgctgtcagaatgacggtatcagcttccgtaatattcgccttattgagcgtgctgtcatcagcggcatgtccgcggatgaaatggacgttttcaataagcggaccttcccttaatgaatcatcaatcaggacgacagtttttgacggtgcgatgtgctgcagctctttcagcagcatatgcgatttttcgttccatccgataagaatgacgtgccccttgcctttaaaggcgaccttcccttcgacatagcggtgctgtttgctgaacacggctgaagaaagcgtggcgaaataggcggtcacaaaactcgctccgcttaatacaagcaccatgccggcaatctgcccgagcggcgtctgcggaacgtaatcgccgtagccgactgtggccaccgtaatgaccgcccaccaaaccccttcaaacacagacgtgaattgcttcggttcgagcatgtaaatgagttggccgaacaataaaatcaaggcgataatgatcagcccgatccgaacatataacggccatctcagccaggaaataaaaatacggtttgatttcattcgtccggctcttctttcgacagagagatggataaaatctgcttaataatggtgtttagtttttcgtccagctgttcctggccgtatgagtcacgcgcatgtctgattaaatcggccgtctcatcttcaaactgaatgagaggttcgtcgttttctgattcattatagagctggatgaaggcgtcaagcccttcgttcattctgtctatcgcattgctcagctgttctttctcgccatttgtcactttcatgtcgatcacacctgtatctttttttatacagtatgtcccagttcgtttgatgtctttcaaaaatcgccgaaaacatattcacccttattttttcatatgataaagaaagcggaccgaaaaagggtgagtcaaatgacggtcattcaaaaactgttggcggcgctggccggagcgcagctgcttgcttcggcggccgtattgcttattttcgatttgaatggatacaatcacatgtccggcggattttcatggcttgtttttgcaaaagagaccgcaggcacgtttccgttttacatcggaatggccgggtgtatcctcatcatgctcggaggattgattcctgtcagaaaaaagaagcggatttctgtacaggaaagcgggcaatcattaaaataatatataagcagatcgtacgatataagagaaaaaggaagaggataatatgctgtttatctttttaacaattgctgcattgggtttgtcgttttgggcacaatttaaagtgaaaagcaattttcagaaatactcagacgtggaagcctccagtcagcggacgggggcggaaacggcaagacggattcttgatattaacggtttatatgatgtgccggtagaaccggtaagaggcactttaacagaccattacgacccgacggagcgggtggtgcgtttatctgagccggtatattacggccgctccatttccgccatttccgtcgcttcccatgaagtcggacatgctttgcagcatcaggaatcatacggcgcgcttgtgctgaggcacaaaatttttccggtcgtcaattttgcctccggggtcgcccctctgcttttcttgggcgggatgctcctgggcagcttgaacttaatcggactcggcattattttgttttcggccgctgtttttttccagcttgtcacactgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaatggtcgtgatgagaattaacacgaaggaggtggccccttaccgtttgcggtaggggtttttttgcttatattaaaactgattctcattatgctgttaatcggattaacggccatctttgtcgctgcggaatttgcgattgtcaaaatccgcggttcaaaaatcgcggagctggttgaaaccggagacagccgggcgctcgcggcgcacagggtgatttcaaatctcgatgaatatttatcagcgtgccagctcggcattacgattacggcgctcggactcggctggctcggtgaaccgacgattcagcggcttcttcatcctgttttcagcctgatcggaatgccgtcatctattacgcacgtcgtcacgtttattgcggcgtttatcgccgtcacgtatctgcacgtcgtcatcggagagcttgcgccgaaaacgatatccattcaaaaagccgaagctgtcagtctgtggacggcgaaaccgctcattctgttttataaagtgatgtatccgtttattaagctgttaaacggctcagccggatttttggtcaagctgttcggttttcattcggtgaaagaacatgaggtcgtggtcagtgaagaagaattgcggctgattttgtccgaaagctataaaaaaggtcaaatcaatcaatctgaattccgttacgtcaataaaatatttgaattcgataaccgggtcgccagagaaatcatggtgccgcgcaccgaaatcgccgtcatctcgcttgaacagtcagttgatgaagccatacatttgatcatcaacgaacggtatacgcgatatccggttattaaggaagacaaagatcacattctcggcattattaacaataaggatttatttaaagcgtattttctcggccgctccattgaattaaaagaaatgatgcgtccggtcatcagagtcattgaaagcatccccgttcaggagcttttgatccgcatgcagaaggagcggattcatatggcgattctcgttgacgaatacggcggcacggcgggacttgtgaccgtcgaagacatattggaggaaatcgtcggggaaatccgtgatgaatatgaccaggatgaaatgccccacatcgtcaaaaaaggcgaacaccattatgtgatggacggcaaggcgctcatagaagaggtgaatgatctccttgatatcgccatcgaaaatgaagacattgacacgattgccggctggctcttaacacaaaaaatggagctgaaaaatggtgatgtgtttcatgccgaagggtgtgaatttaaggtgctggaagcggaagaccatcatatccgcttcgttgagattaaaaaaactgatttctgagcctcctgcttttgcaatgaggctttttttatggaaaaaatgcttcttcgtcccgctccttcatatgctgtaaagaaaggagtgtcggtatgaaaacggattggtggaaaacggcggccgtctatcaaatttatccccgaagctttatggattcgaacggggacggaatcggcgatattaacggcatcagagcaaagcttcattacataaaagagttgggggcggatgtgatctggctttgtcccgtttttgactcgccgggcgcggacaacggctacgatattcggaattataaacaaattgccggcgaattcgggacgatgaaggattttgaccggctccttgcggatgtccatgcgctcggcatgaagctgattatagacctcgtcattaaccatacaagcgatgagcacccttggtttatcgaatcacgctcagcgaaagattccgaaaaacgggactggtacatctggagagacggaaaaaacggcaaagagccgaataattgggaaagcattttcggcggatcggcgtgggaatatgatcaagagaccggccagtattacctgcacctgtttgacaaaaaacagcctgatttaaattgggaaaacgaagcgatgaggcagtccgtttatgagatggttcgctggtggcttgataaaggcatagacggcttccgggtggatgccatttctcacattaagaaaaaagaagggctccctgacatgccgaacccggacggtctcccgtacgtcccgtctttcccgtatcatatgaatggggaaggcataatggatctcttaaaagagctgaagcgggaaacattttcgcgctatccgatcatgacggtcggcgaggcgaacggagtggcggcttgggaggcggctgattgggccggtgaagaaaacggcgtctttcaaatgatttttcaatttgaacatctcggcctctgggatacggaagatgatcaaagcatctccattccggcgcttaagcgcgtcttgtccggctggcagtacagccttgaaggaaagggctggaatgcgttatttatggaaaatcacgaccagccccgttccgtttcggtatggggtgacgaacggtttttgacagaaagcgccaaggcactcgccgtgatgtatatgctgatgaaaggcacgccgtttatttaccagggacaggagctcggcatgaccaatgtttcgttcccatccattgaagattatgatgacgccgcaattaaatatctgtatgaaaaagagacgtcccgcggcgttccgcatgaacaagtgatgaagatcatctggaagaagggccgggataattcacggacaccgatgcaatggagcggtgaggcgaacggcgggttttctgatgcttctccgtggctcggagtgaatccgaaccacacatggctgaacgctgcatcacaattgcaggatgaaacatccgtataccatttctacaaacggctgctcgccctcagaaaaaaacacggcgtattgatcagcggcacatatgaattgctgcttccgaatgaccggcagatttatgcctatctaagaaaaaacggaacaaaaaccgccctgatcatcaccaatctgtcccgaacccccgctttatacaggcatcccggttatccgcttgactccgattctctcgtgcttgcaaacgtggaaacagaatcgcaccgccatgtgacatccttcctcttaaagccttatgaggcccgcgtatatatatggtgaaaaacttcagtcccgaggctgaagttttttgtgatctgtgtttatcatcgcgatccgacaggaaaagacaaatacagaaacgaatatgggaaaggaagagaaaaagaaaggaggcattcatatgctgaaaaaattgcagattcaaacaaacaaaagggatgaaatgatcgacatcacacatgaagccgaatcgtttctccgcgaaacaggcgtaagaaacggtttggcgctcatatactgtccccataccaccgccggcattaccatcaatgaaaatgccgacccggatgtgaagagggatatgctcagaaggtttgatgaaatgtatccgtgggagcacgaactggaccggcatatggagggaaatacggcggcacatatgaaagcgagtacaaccggcgcctctcagcatgtcatcatagaagacgggcgcctgatactcggaacatggcagggcgtttatttttgcgaatttgacggtccgcgaaacagaacatgttatatcaaaatactggctgaaacggaggaaaacaaatgagtgagtggatgagtccgttatcattaacaaagcccgtcattcaggccccgatggccggcggactggtcacgccgcgtctggcttcggcggtatcaaatgaaggggcgctcggaagcctcgcttcaggatacgtcagcccgcaagcgcttgaaaaacagcttatcgagatgaaagagctgacggaccgctcctttcaagtaaatcttttcgtcccggaagaaagacagatgcctgaggcggaacttgttgaaaaatggaaagcccgcattccgagggcaaaagacgccaagccgttctctgatctgaaagaagaatggaatgatttcgcggaaaaagcggagcttctgatccgttacggagtcaaagcgtgttcattcaccttcggcctgccgccggaaaaaacggcggaaaagctgaagaaaagcggttgtttccttttcggcacggcgacaacgccggaggaagcgaaggcttttgaagaacggggaatggacgccgttatccttcagggaatagaagccggcgggcatcgcgggtcgtttctgccggttaaaggagaaccggctctcggccttatggcgctgattccgcaggctaaagacacgctgaatatcccggtgattgcggcaggcggcatttttgaccgccgcggggtgcaggcggcccgatgtttgggtgcggacggcgttcaagtaggaacaccgtttctcctttgtgaagaaagcagcgcctcaccggcatatcaaaaagccattgccgaatcaaaaggagccgatacgcggctgaccaccctgttttcaggaaaacaggcgcggggaatcgtgaatcagttcatgaaaacatatgaagctgacgagggaaaaacgctgccttatccgctgcataatacgctgacaaagccgatgcgcgggcacgcggctcaatcaggagacgcggagcatatgtctttatgggccggccagtccgccgcgaaacttgaggggccgacagacgtgaaaaccgttttggacagattgtgcgaatcataatccagaaatcgtgaggtgatggatgatgaagattcttcaaatgtcctataaaaaaagagggactattgagtttgtctttgaagattttccgcattccaaagtcaccatggcgccgattaaagggtattactttgtccgcgccattaaatggagcagacgggacagagccgtcacccgccatgatttagagaagtttgaatgggctgcaaaccaagcgctcggcacgacggctttttaccggaaaagaaaagcatttcacatcccatcgtcacaatgacagacgatgggattgttttaatgcatgatctgataaagcgcgggtgcatcaagccttgttgcctggttaagcagataagccggctgcacggcatttttttttcttaaagaattcaatctctggatgatttgttcagcggtcagaatcccgagaccgtgggcgaaatattgatcattccccatcacaatgacattttctccccgccactgagcctttgcagggttaaaatcaggatttttaaaatataaacagtctccccgtaaaaagtggctgccggtttccgtgtagatcggcagatgctcatagtgccagtcatacaaagtgatatcccggaaacgccggttaaaccgttcttcaccgattgtctttaagacggccagataataaatcacaacaatggcggtagcgcattcaaatgcgtaaaacgccccgttttcaataatatcccgaatcgcttttgaagcgggaatcctgtacttcagctccagggctccttccggcgtcagtctccaataagccgtatttccgtatgttttggcgaaagttgcaaatttcacacctgatccgtgcagttctcttgcggcttccacaatatggcggcgcagccgcacctcgaacatcagttcagcaatcgacccgtaatcgaattgtacgggagaattgagcagttcatttatatacggaacaaggctttcttccgtctgccagttcgcgatgtcctgaggccgaagcacttggccggatatgataatcatctgcgcgccccctatctttttttataagatatgcaggaagcttgggcaatgaaaatcaagtgataaaaaaggaggaaatgttaacaaaatgtgaagactgagccgatatataaggtatcacacttgagggagcagcttaatatgaaaaaattcattaattggtgcacaaaggcatcgatttcacggaaattaatcatttcatttatcgtgatcttaatcataccgattctcgtgttagaattcagttcataccatacggcgagcaattcgctggatgatcagatttcaggcaacgcgaaaaataacatcgaatcttttaacacaacgattacaaatgatatcggcgcaaaagcaaaggcgattgaatttttcagtgaaacgttaaaaggatcatccttctcaaagaaaaacatgtctgctcttgaagaaaagttcgggcaatacacgtctattcataaggacgtagcccgcatttacggaggaacggaagacggcagctacgcacaggcgccgaaggaaaatactccggccgattacgatccgagaacacgcacttggtataaagacgctgtgaaggccggcggcacgctcgttgtcaccgacccttacaccgcggcaagcgacggcagcatggtcattaccgtggcaaagcagatgcaggacggaacaggcgtagtggccatggatattacgattgaccagctgctgaagcagatgcagggaatcaaaatcgggcaaaaaggattcgtgtttatcacgtccaaaaataaaacctatgtcgcgcataaagaccacaaaccgggcgataaagtttcaacgccgtggctgaatgaggtatacagcaaagacagcggcattatttcatacaagctcgatgatcaaaataaaaaaatggcgtttacgacaaataaactgaccgggtggaaaatagaggggagcatggagctcaacgaaattaaagatgcctcacaaccggtgctgacgatggggatgattgtccttgcagcatctattatcatcgggggaattttaattctgttgattgtcagatccattacgtcaccgctgaaacggcttgtccgctcttctaaacaaatcagcggcggagacttgactgaaaccattgacatccgctcgaaagatgaattgggcgaactcggcgcgagctttaatgaaatgggagaatctttgcgcggactgatcagcgcgatccaaaactctgtcgataacgtggccgcgtcatcggaagagctgaccgcttcagcttctcagacaagcaaagcgacggaacatattacaatggcgattgagcagttttcaaacgggaacgaagagcaaagcgaaaaagtcgattcaagctcagccaagctgaatcatataaatgacggactcgccgccgtttcccgcacatcatcatccattacggaggcatctaaacaatcgaaggaagctgccggcaccggggaagaatatgtgcagcaaaccgtcgggcagatgaatctcatcaatcaatcggtccagcaggcggaagcggttgtaaaaggccttgaggccaaatcaaaagacattactcatattttaagagtcatcaacggtattgccgatcagacaaacctgcttgcattaaatgcagccattgaagcggcaagagccggtgaatacgggcggggcttctcagtagtagccgaagaagtgagaaagcttgccgtccaatccgccggttctgccaaagagattgaaaaactcattcaggaaatcacggctgaaattaatacttcgcttcacatgtttacatccgttaatgaagaagtgcaatcaggacttgccgtaacggatcgcacgaaagaaagcttccagaatatcttcggcatgacgaacgacatcgccgaaaaactgcaatcaatgaacggcacggttgaacagctgtcagacagctctcagcacgtttcagccgcagtgaccgatattgcggacgtatcacgggaaagcgcagcaagcattcaggatattgccgcatccgcagaagaacagcttgcatcaatggaagaaatcagcacatccgccgatactttggcgcaaatggccgaagaactgcgggaattaacgaaacaatttaaaatcaactagtaaaaaaggacgctttccaggtggaaggcgtccttttttatagtgacagccggataattaaataaaaagtcttgcatacaaagggagtacatagaactatttttcatttatgacttaattttcaatgtaataaaaagggagtcggccgatataaacagtaaatgattgaaagaggtttacaaaattgaaaaaaacagcaaaaaaaatcgccagaaaatcaatagccaaaaaacttatcatttcatttttactgatcttaattattccggtagcagtattggccgccggcgcctaccgttcggcggcttcatccgttgaaaagcaaatgatggaaagcgccgaaggaaatgtgcaaatcttaaacaatatgattgatgaccggatcggaatgtttacaaaaagctctgcatatttcagcgaatgggcgacaagcgctaaatttaaagaaaaaaaccaaacggaaatgcaagaaaggtttaaacagtttattgaaagcaatgataaagcgtccgccatattttcaagcagcaaggaaggaacgtttacccgttatccgcatgccgatatgccggccgatttcaatccgcttgaaagaagctggtatcaggaagccatggagaataaaggccaaaccatcatcacggacccttatgagtccatctcaaacaaaaagatggtcgtcaccatggcccgcgcggcgcaagacggatcaggcgtcgtcgccattgatataaaaatcgacgatctcatcacgatgacaaaagaagtgaacatcggaaaagaaggatacgcctttatcctcagcaaaaataaaaaagccgttgcctacagtgatgaaaaagccggcgcggcggtatcgggaaaatgggttgatacattatacagcgggcaaaaaggcgactatgaatatacgctgaacgggaaagcgaaaaaaatggcgtacgtgaccaatgaagcgacgggctggaagatcagcggaaccatgtccgtggatgaaatcaaggatgcggcaagaccggttctgactctggccgttatcatattggcgatagccgttgccgcagggatgattttcatttattttgtcatccgctcaattaccaaaccgttaaaacgtctcgtagcttcagcggaaaaaatcagcagcggagatctgactgaaaccattgatgtcagctctcaagatgagctcggcgtgctcggtaaaagttttaatcatatgacagattcactccgttcgcttattcagggaattcaggactctgttgaacatgtcgcttcttcctcagaggagctgacggcttcggctgagcagacgagcaaagcaacggaacatatcacccttgcgattgaacagttttctaatggaacggaagaccaaagtgagagtattgataaagcgacagcacaagtgaatgagatgaaagacgggctcagcgatctggcggaagcggcagccgttgtgacggaaacttcaattgaatcggcggagatatccggcgccggtgagcggcttgtcaagaaaacagccggccagatgggcgccattgaccaatccgtaagtaaagcggagcaagtcgtacaagggcttgaactcaaatcgcaggacatcaccagcattttgcgcgtcattaacggcattgccgatcaaacgaatctccttgctttaaatgcagccattgaagcggcaagagcgggagaatacggacgcggtttttcagttgttgccgaagaagtgagaaagcttgccgtccaatccgccgattcagcgaaagaaatcgaatccttaattcatgaaatcgtcaaagaaattcatacttcgctcggaatgctggaatccgtcaatcacgaggtgaaaagcggacttcagttaacggacgaaacggaaaaaagcttccgggacatttccgctaaaacaagtcagattgccggtgaactgcaaaatatgaatgcaaccgtggaacagctttctgccggatctcaggaagtatcaaacgcttcagaggatatcgcggcagtctccagacaaagcgcggccggcattcaggacatcgcggcttcagctgaagagcagcttgcgtccatggaggagatcagttcctcagccgtcacgctggaaaaaatggcggaagaattacgcgaactgacaaagcgttttaagataaactcttaattaagtctaaaagactaattttgcaataggtaaaaagtatgtttcgttatatttcttctttttggatgtgtatatttacccataattgccgatatgaagggtaaacacgcaagaggagatatagcagatgaaaaaaattgtgcaaatcatcaagcagagatcgcttacaagaaaactgctcatttcttttttggccattctcattcttcctatttcaacgctggcttttatcgcctatcaatcggcggtaagtacgcttgacaggcagatgatgggaagcgcattagataatgtgcagcagattaacgatatgatcaacacaagcatcagccaaaaggaagacggaacggcatatttcagcgactggctcacaaaggatcggtacaagccgaaaaaccaatcgcaaattaccgataaattcacagagtacatgaagattaataaagacgtggaatccatctatacgagtgacacggaaggacatttcacacggtatccggatctgcagatgcctaaaggatataatccgcttgaaagagactggtataaaaaggccgtggaaaataaggggaaagttgttgtaacagatccttaccgcacggcttccaccaatacgatggtcgtgacggtcgttcagcagacgaaagacggctcaggggtcgtcgccatcaatatgaaaatcgatgagcttctgaaaacgacaaagaaagtgaacatcggaaaatcaggctacgcttttatcctgacgaaagacaaaaaagtggtcgcccacccgaaccgtgcgtcaggcacagtattaaacggggagtgggctgaacagttgttcaccagcaaaaaaggtgattttcaatacaaatacgacggccaggaaaagaaaatggcttatgatacgaacgggctgacaggctggaagattaccggaacgatgtatctggacgaaattcatgaagcggccctgccgatccttcatctgtccctgctcgttctcgtattagcgattgtcatcggaaccatcgtcatggtgctgattatccgttcaatcacaaaaccgctcaagcagcttgtgacatcatcgaaacagatcagtgaaggcgacttaacagaaacgatcgaaattcagtcaaaagatgaattaggcgagctgggcaaaagctttaacaatatggccgcttcactcaggtctctcatccatgccattcaggattccgtgaataacgtcgcatcttcctcagaagagctgacggcttcagcggagcagacaagcaaggcaacggaacatatcacactggcgatcgaacaattttctaacggaaatgaaagccaaagtgaaaatatcgaaagcgcggcggaacatatttatcaaatgaacagcgggcttaaagatatggcgaaagcatctgccgtcattaccgaatcctccgccacatcagcggaagtcgccaattcaggcggaaagctcgtccaccagacggtcggccaaatgaacgtcattgaccggtcagtgaaagaagctgaacaagtggtgcgcggacttgaaacaaaatcaaaagacattacaaacattctcggtgtcattaacggaatcgctgatcagacaaaccttcttgcgctgaacgcggcaattgaagccgcgcgtgcgggtgaatacggccggggcttctcagtcgtcgccgaagaggtcagaaaacttgcggtccagtctgccgattcagcgaaagaaatcgaaagcttaattatagaaatcgtcaacgaaatcaatacatctctcggcatgttccaatccgtcaacaaagaggtggagagcggactggatattacgaatcagaccgaaacgagcttcaaacggatttctgaaatgacgaaccagatcgccggagaaattcaaaatatgaatgcgacggtagaacagctgacagcaggatcacagcagatttcaggagcttctgagcaaatcgcgtccatcgcaaaagaaagctccgccagcattcaggatatcgcggcctctgccgaagaacagctggcttcaatggaagaaatcagttcgtcttcggaaacgttatcccaaatggcggaagaattacgtgatatgacgaaacgatttaaaatagattaatagatcatagaacacccaaatgtgctgtttgggtgttttttttagtttttttaataaatcttttgtcctatctgacgatattagatttagcttttcaaagaaggagactgaaaaaatgaaacaactgatacattggatcaaacagccatccatcagcaagccgctgatcgcggcatttttagccgtattggtgcttccggtcggcatactcgcctacttcagctaccaaacggcggggagtacattagaaagcgaactgacccacagcgcccagggaaatgtcagtgaactgaacagcgtgctggaaaacatgcttgagggtaagctgaaagcgattgactactacagcgaatcaatcacaaaggaaaaactgaacacgaaaaataaatcggtactgctcgacaatatgaagcagtatgtcaccgtaaatggcgatgtcgcgtcaatttacgccgcgtctcgcgacaaagcgtttgtgaaatatccgtccgctgacatgccgtccgattataatccgctcacgcgcgagtggtatacaaaggcggttgaaaaaagcggacagccggtgtttaccgagccttataaagacgctgcaaccggacagacggtcgttacgattgcccagcagacaaaagacggatcaggcgttgtggcgcttgatattaatctgggcgacctgctgaacgcttccgaacgcgtccagatcggtcataaaggatttgccttcattacaacgggggataaaaaatacatcgcccatccgactataaaagcgggaacggaaggctccggagagtggacgaaagaagtattttccaaatcaagcggatcgtttgaatacatgtttgaaggacagcagaagaaaatggctttcacgacaaacaaactgacgggctggaaaatcgccggcacattttttgtcagtgagatccatgacgcagcctcgcctgtcatgaaaatggcgctgatcatcctggcggtttctcttatcgtcggcggtattttaatcttctttatcattcgctcgattgcaaaaccgctcaaaaaacttgtctcgacatcagataaaatcagtgacggcgatttaacggaagtcattgacatcaagtcaaaaaatgaattcgggcagctcagccaaagcttcaatgagatgtcggcatcactccggtctgtcatcggcgtcatccaatcatccgtcgaacatgtcgcttcttcatccgaagagctgacggcatccgccggacagacaagcaaggcgacagagcatattactctggcgattgaacaattctcaaacggaaacgaatcacaaagcgagaaattggaagaaagtgctgatcacctttcccaaatgaatgcgggcattgccgagacggcgaatgtatcggcggaaatcactgaatccgccatccaaacctctgaaacggccggaagcggagaagaattagtggcgaaaacggtcggccagatgaaaacaattgatcgttccgtacagcaggcggaagccgtcgtaaaagggctggaaacgaagtcgcacgacattaagagcattctgaacgttattaacggcattgccgatcaaacaaatctgcttgccttaaacgcggccattgaagcggcaagagcaggcgaatacgggcggggcttctccgtcgttgcggaagaagtgaggaagcttgccgtacaatcagccggctccgcaaaggaaatcgaaacgctgattcaggaaatcgtcaaagaaatcgccacatcgctttccgtattccaagcggtgaatcaagatgtgaaggaaggcctcgatattacggatcaaacggccgaaagcttcaaaaaaatctcagagatgacgactcagatttcaggcgccttgcagcatatgaacggaacgcttgagcagcttgcagccgggtcgcaaaatgtgacaaacgcggtggaggacattacctcagtcgccaaagaagggtccgccggcattcaagacatcgccgcctcagctgaagagcagctggcctccatggaagaaatcagttcatccgccgaaacgcttgcgcatatggctgaagaactgcaacaggtcacacggaaatttacgattcagtctgaagacgaagaacagctgtaacgagctgtttcttttcctcatctgaaaaaagcgatacactaatataaaagaagggagtggcagtgatgagattagaaggcaaaaaagttatagcgcttgtcagtgacgattttgaagacttagagctttggtatcccgtctatcggctgagagaggaaggcgcgatcgttcatttaataggagaagaagcgggccgttcatacaaaggaaaatacggcgtgcccgcgacggcggattacgattttaagagcctgattattcaggagtatgatgccgtgctcgtgcctggcggctgggctcctgacaaactgcgaagatatcccgaagttttggacatcatccgtacgatgaacgagcagaaaaagccgatcggccagatctgccatgcgggctgggtgcttatatctgccggaattctcgcaggaaaaaaagtaacgagcacgcccggcatcaaagacgacatgacaaatgcaggggcaaagtggctggatgaagctgtcgtaactgacggccacattgtatcaagccgccgcccgcccgaccttccgcagtatgcaaaagcgtttgctgacctgttagcgtccaaataaaaaacatccgcccgaatccgggcggatgtttttagttttgatcggcgggaaagacgattccgatttgttttctcgcttcttccataatgtttgccgtaatgaaagaacgttcaaatgtattttcggaagactcccgctgtccgtttcgaagaagattgatgaattcagccgtttcgtagtacatcgaaggtttcagatcagggactgaaatgtcttccgtccggccgtcacgatagcggatttccgcccgttccggtccgtgaatgctgtccagaacgatcgtgccttcttcaccctgaatttccgccggggcaaacgaatttgagattttcgaatgcatcagcaccgcttcaaatccgtcgtatgacagaatgaccgtgccttcgccgtcaacgccggatgctagtttatgaccggtcgcaatgacgtttttcggtttgccgaacaggacgacggccggataaatgcagtacacgccgatgtccattaacgaaccgttcgataattcaggcttaaacgcgttaagcaccgtaccgtttttatatgcatcatatcgtgatgaatattggcagtagcttgccgtgaatctcctgacgggtccgattttatgtaagtggttttgaagcatgctgaagttcggcaggaacgtcgttttcatggcttccatcaagagaacgccgttcgttttggctgcgtgaatcatttcatccgtttcccttgcgttagacgcaaacggtttttcgcatagtacatgcttgccgtgttccataaaaaggaccgcctgctctttgtgaaatgcattcgggctggcgagatacaccgcgtcataggctttgctttccgccatttctttcaggctggtgaaataatgagcagcgccgtgtttgccggcgaattccgccgcacgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctttttttcaaagaaacataaatggaaaaaaggctgccagctaaacggataggaaaaattcccatagagaccggttattatttttcattacaggaacgatagtgtacaatttaagtaaaatacatatgatggaggaacaatagtggaaacattgcaaacatggggcggcagatttaaacagtttttcttagacaataaatttgtcttgtttttgcttgtattgctgctcatcggtctcaatatccttgtctttatgaagacatcatttattttcacacccattatcgtcctgctcaaaacgattgcgctccccgtcattttgacaggaattgtttattatctgcttaatccgatcgtagatatattggaaaaaataagagtgaaaagagtctattccatcctgctcctttacctcattattatagggctgatttcgattacggtcgtttcaattattccgtttttaaaggaacagatcatgagcctgatcgacaacctgccgaaatatgtggacatcgttgaagatcagacgaaaagcctgatcggaagcgattttgtaaatcaggcgcaaaagacgatgaatatcaacatttcggatcttgccaataaagtatcggcgcaggcggcgacaattgcaaacagcacatttaccggagtcgggaattttatcggcgcgctgactgaagtgattatttcaattgtgaccgtgccgtttattctgttctatttgctgaaagacggcaaaaaactgccgatctatatcttaaagtttgtgcccacccgtctgaaagaacaaacgtatacgatgctgagtgaaatgaaccacagattaagctcctatatcagaggacaggtcatcgtcagcttctgcatcgggtttttattatttatcggctatctgattatcggacttgattatgcgtcactgcttgcggtcattgccgcttgtacgagcgttgttccgtatttagggccgaccattgctatcacgccggcgattattatcgcgttggtcacttcgccctttatgctgctgaagcttgcgattgtctggaccgttgtccagctcgtggaagggaaattaatttcgccgcagatcatggggaaaaatcttcacattcacccgattaccatcatctttgttcttttaaccgccggaaagctgttcggggttgtcggcattattttagccatcccggggtatgcggtcatcaaagtggtcacgacccatctgtttgattggttcaaaatgcgttcgcatttatatgaagaagaaaaaaatgatgctgtatcgaagtcataaaatcggaacggacatgatatttattataagacaggctttccttcaaaggagagcttctcttttgtaaatgatgaatgaagggaagaatgggatgacactatgggagatgttcacagcagccgttttgggaatcgtggaagggctgacggagtacgcgccggtttcttccacgggacatatgatcatagcggatgacatctggctgaaatccggaagcctgatgaatccggaagccgccaattccttcaaagtggtgattcagctcggttcgattctggcggtggccattgtgtttaaggatcggatattacatttactcggcctcaaaaaaaacgtcacgcgcgatcagcagaagggatacaggctgaccatcgcgcaaatcgccgtcggtcttgttccagcggcggtgctcggctttttatttgaggatttcattgaccgctatttattctccgtcagaacggtcgcttacggattaattgccggagccgtgcttatgcttatagcggactggatcaataaaaggaaagaaacgatcgatacggtggacagaatcacctacaaacaggctttctgtgtcggattattccagtgtctcgccttatggcccggattttcccgatcaggctcaacgattgccggaggtgttattgtgggcttgaatcaccgggcagccgcagacttcacatttattatggcgattccgattatggcgggcgcaagccttctgaagctggtgaaatactggagcagtctttcttatgacatgattccgttttttcttgtcggctttatctgcgcctttgtcgtcgccctcttagtcgtcaagttttttcttcggctcattaaccggattaagcttgtcccgttcgccatttaccgtgtcatcctcggcatcattttaatcatgctcgtgcgataaacgaagaggccccccggagggtcttctttttatgttcgaaaaacgtctcaggaaaatatgagcaaactgaattttctgcttgaaattcatagaagagtcgtctataataaaacatgacgttacagcacggggccatagctcagctgggagagcgctacgctggcagcgtagaggtcaggggttcgagcccccttggctccatacctttaaacccttattctataaataagggtttttttgttttttcatcctctgcagcagcctctgtgttccgcttcatttctaacaactcaaaataaaggaaagagagaaaatgaaaaagaaaatctatcttatattatctctgtcagctgcactggcacttcttttaacggcgctcccggctctttctcctgtcatcttcacgtctgcttcagaaaaaggagccatcaggcatgacatttataaaaaaggatatccgtatcaaagctactttgcgattcttcaaaaagaagaaggaggcggagaggacgggaacctttattatgtaaattggttcaattggaaagatgaaaccggacagacgccgcacgtatgttattcaaaaaaatcgtccgaaggcgagtacaaagtaagctgcggaaccggatcgtaatgatcaagagcccctctgcaatgaggggctctttctgtcgatgtggatccgcttaataccccctatagaacggctgaacataatgccgatacggatcattcggataatgcgtatttggctgataaggcttattcatatcatgaatacccgtgttttcagactgtccgcagtatttatcgggacctatcacagttgattgccggatcggtgaaacggctttttcccactcgtgctcattcagacagtacgtatgcgccatgatctcaggcggcgtcagacggagaatatccgagccatatatcacttcaggcgaaggggcgtcaaatatggccaaaaggtgggttttgtctgaagtggcgacttcataatgccaccacccctgcggaacattcgccacttgtcctggagagatcggataattccgtattttctgggtgaacggattcagcatcgacaccaccgcggaacccgaaatacagtacaccaattcagcggcgttttgatgggtatgcggttcaatcacatttgttttactcagaaagatatctaataatgaaatattttcaagcgtgtttaactgtttaatccccaatacattgataaagttccgagcatctttcgtaaaaaaacggctctcatttacatcataagtgaactgtgtattcggagacgtgtaatcgatatcggaaaccatgcaatcccccgctttcatctttaaacgtatattcccaaatatatgtgtccctgtttcaccgggtgataaaaaaggaggtaaaatccataaattccaaattcaacacaatattgtgacgacttttttaaagattcattttagatatatcttttattcgaaatatctcttactataaagatatattaaaaatacatctttagaagggttgaggatgaacatgctggatgagagaacagtagacatcatcaaaagcacagtacccgtattaaaaacacatggagaaaacatcaccggacgcttttataacctgatgtttcaagatcatcccgaactgttaaatatgtttaaccaaacgaaccaaaagaaacagactcagcgcgcagcattggcaaatgcagttattgcggctgcggcgaatattgatcaattagaacaaatcattccggcggtcagacagatcggccataaacacacaagtatcggtgtaaaaccggaacattatccgattgtcggaaagtatctgcttctggcgattaaggatgtgctgcaggatgccgcaactcctgaaattatgcaggcatgggaaaaagcttacggtgttattgcggaggcttttatcggcattgaaaaagacatgtacagtgaagccggatggcaggggtataaagaatttacggttatacagaaaacaaaagaaagcaaagatatcacatcattttatatcaaaccgagtgacggctcttcgcttcctggatttgaagcgggacaatatatcagcattaaagtgaggattgcggattctccttatacgcacattcgccagtacagcctgtctgatgcttctcgaaaaggcgcatatcggatatctgtgaaaaaggacggagcggtttcttctcatctccacaatgaagttcaagagggagataaacttgaagtcagtgcacccgccggggatttcaagctgtcttcttccgaaaaaccggttgttcttatcagtgccggttccggaatcacgccgatgatgagcatgctgaaaacagccgccgaaaaacagcccgagcgttccgttacttttattcatgccgcgaaaaacggagagtacgccgcgttccgcaaagaggctgaacaagctgcggagaatcatccgaatattaacgtcatttatgtatacagtgaaccggcagaacaagaccgctcaggagacaagcctttttacagcggccggattgatcaaaccttcttggagcagcttcatctgaatcaagatgctgaatgttacttgtgcggatcagcacagtttatgacgcaaatgaaagatatgattcttgcactcgggtttgactctgattccgttcaatttgaattgttcggccctcagctgagcatggcataacaaaaaaagactcctcattgaggagtcttttttatttgcacgatgtgttctttctccgtctttttccctattttattgaaattttcatcaatgaccagtaaaattataaatctagtgattccggaattaaaggaaggttgatatgaaaaagaaagcaaagaccaaaagggtgcttgggtgcctttttgctgtatctcttatattcggattatttctggtatcaatggtattttcgaaattcatagtgacggaagaaaaaccgcctgaagaggtggacgagcagcaggtctttattgacagcctttccgggcatgctcaaattttatatgagaaatatcatgtccttccgagcatcaccctcgcacaggccattctcgaatcggactgggggaacagtgagcttgcggggaaagcgcgcaacctgttcggtgtaaaaggtgattataaaggaaaacacgtcacgatgaaaacggatgaatttgaaaaaggaaaacgaaaaacgattcgggcaaaattccgtaaatacagcacgttttttgaatcaatggatgaccatgccaaattatttgtcaacggaacgtcttggaataaaaagaagtacaagcccgtcattgaagcggacaattataaaacagcggcggctgcccttcaaaaatccggctacgccacagaccccggctatgctgaaaaaattaaagatgtcatagaaacctataacctgaatgaatatgacaaaatcaatgcctctcttaaagcagttgataagaaaggcgccatcaaagaccacgccattgaagacgtgtggtccaagccgtcgaaagagcggcattctattaaactggcatcggcgcaaaagtttaccggccagcatattaaagtcgtatctgaaaaacaaaacggagaatccgtctggtaccaaattcaagtgaaagataagctggtcggctgggttgaccaaaccgccgtccagttaagtgaagaaacataagcatcaaaaaaagccggcagcttgccggctttttttacattccttcagtttcaaaccttttaatatcacgtttatgccccatcagcacaaggcagtcacattcatgaatgacagtctccggagaaggggacagctgaatgtctccattatgtttcacggcgagaatggtgcagccgaatctggcgcgtgcgccgagatcaagaagggattttaaatgcagctttttagtggctgaaagctccacaatgctgtattcatctgacaaatcgatgtaatttaagacgttttcatctgaaaggctttgcgcaatccgcacgcccatatccttttcaggatggataatacgatcagcaccgatcttttcaagcactttgtgatgataatagttttgcgctttcacccaaatattagggatgttcagctccttcaataacagcgtcgtcagcgtgcttgcctgtatattggctccgattgctacgatgacatattcaaaatttctgatgccgagcgactgaagctcgctttcttccgttgaatttgcccgcacggcatgcgtggcataagaggagtatgcgttgacccgctcttcgctgatatcgatcgcaagcacctcatgccccattttaaaaagctctttacagatgcttccgccgaaacggccgagtccgatgacggcaaattgtttatttttgatttttcccaatcctcataactccttaagaaactgttttcgtcactccaaatacaacaaacaagaatgtactcctgtttcaggggtttgtcaatgcgagggccggaagaaagaaaacagcacaaaaaaagaccggctgacaagcgatgagcttgtgccggtccgtttttcgcaattatttgcagttgcatggctgtgtcggcggtgtgctgcgtttttgaacaacaattgtgtcctcagcatagaatttagagccgatgcttaatgatttattttctgcacggaacttatatgtacctgcagcaggcaatgttttattattaagagaaagcttaaattccgctgcgccgagcaaatcaatgtttaacggaagtctgactgttttgccgttattcagaatctgtctttcgcgcaaagcgtgtccgttgactgtatcttttgttgtagccgcaaatccgctaggaagggtaaattccataacgcctaagctcaggatcgtgttcggacggtacgtcaattcgatatcagaaaatgaccattcctgctggctggcacctgtatattttgcaaataaggtagcagtcgctttcgtggacatttccggctcgtgaacggttgagcctgactcagcggcgaatgacgctgtcggcagagaaagaagcaaaaccaggccgaataaacttgccatgacagttgagaaaaacttgtgtttcatttttataaatccccctaaaaaaaatttgctgattgttcttaaaaaagaacgaccatacctataaaaatttaccatcaattttaatggaagtaaatggggttatgttcctatattttctcaaaaataatcaaatcacgacaaaaaacgcctgaatcaaaatcaggcgtttttttcgtccgtttctatcggaataaatttaaaaatctccccgctctgaaccgagtcggcgagccgcttcagccaatgataataagctttcgagctttcaagctgatcatataactgccgcgcttcttcctgtaattccgcgctgccttcctcggccagcaaaacggactgcaaatccgcctgagcctgtacgatggcggacaaattcacctgaacttcacggtcccatttcggcggaaagaaattcgtgaaaaacgtaaagaaatccttttccgctacaaacgtatgcttccgtgtgccgcggtgaaaggtttttttgaccacatttaaatcctgcagctttttaacgcccgtgctcatactcggtttgctcatctgcagttcctcacgcatttcgtcaagcgtcatttcatccctcatatacattgttccgtataaaatcccgacactccgggtgattccgtaaagatccatcgtctctgcaatggaatcaatgacaagatccctggcttgttctatagctgcgaattctggattctcatccatactgtccctcttttcctcttgaagtttaaatttgttaagtcatttctttatgttcttaatcttaacgaatcatgacaaaatgtcaaaatctaaacggactgaccgggttttgacaggcaaaaaaacatgtgttaaattaacattgttaaaaacattaaatttttatttaacaaacttacttctcggtaaggaggactcttatgagcaaaacgctttatatcggcggcgaatggatcagtgcagaaaaaaaacagacccgccgtatcattaatccatttaatcaagaagaaattgcaacggtatgcgaaggagaccgggatgatgcggtgaaagccatcgccgcagccagaaaagcatttgatgaaggggaatggccggtgctttccgggctcgagcgcggacaatttgttctgaaaattgcggaattaatcagacgcgatctgaacgaattagctgagctggaatcgcttgatacaggaaaaacgattgaagaaagtaaagccgatatggatgatatcgcaaatgtatttcaatattatgccggtttggcggataaagacggaggcgaagtcatttcatctccgattcccgattcagtaagtaaaatcgtcagagagccaattggcgtatgcggacaaattacgccgtggaactatccgctccttcaggcgagctggaaaatcgctcccgctcttgcggctggaaacacgatcgttttaaagccgagcgagattactccgcttacaaccattaaagtctttcaattaatagaagaagccggtattccgaaaggggccgccaatctcgtgctggggccgggcgcctctgtcggcgatgagctggcgagaaacctcgacgtcgatttggtctcttttacgggcggaattgaaacaggcaaaaaaatcatgcaggcggcaagcggcaacgtgaaaaagattgccctggagcttggcggcaaaaatccgaatatcgtatttcaagatgcagatctcgaaacagctgcagatcaagcgctgaacgccgtgtttttccatgccggtcaagtttgttcggccgggtcacgtcttttggtggacgaagccattcatgatgaatttttagccgagctgatcaagcgcacgaaacgcatcaaattaggaaacggttttcatgaagatacggaaagcggtccgctgatttccgccgagcatcgggccaaagtcgaaaaatacgtagaaatcggtatcgaagaaggggcaaaactggaaacaggcggcaaacgtcctgatgatcccgcccttcaaaacggtttcttctatgaacctactattttctcaaactgcaagtctgatatgcgaatagtccaagaggaaatcttcggccccgttttaacagtcgagtcattctcttcagaagaagaagtgatcagacttgccaacgataccatttacgggctggccggagcggtatggtcaaaggatattgaaaaatgcgaacgcgtagccgccaaactgcggatgggaacggtatggatcaatgatttccacccgtatttcgcgcaagcgccatggggcgggtacaaacaatcgggcttcggccgtgaactcggcaaaatcggcctggaagaatacacggaaatcaaacatatttaccgcaatacgaaacctgcggctgtgaactggtttcaagcataattaggaggagatacaatatgacattaaatatgaaagtagaaagcatgcataaattccatacattcgaaatcccgacagtcattaaacacggaatcggcgcgattcagcacgcgggaagtgaagtcagagcgcttggcgtcacaaaagcgctgctcgtaacagacccgggaatttataacgcgggagtggcaaacccggtcattgaatctttgcaggaagcgggcatcgaagtcgtcctgtttaacaaagtggagccgaacccgcctgtacgtcttgtaaacgaaggatcagaactgtataaaaaagaaaactgcaacggtcttgtggctgtcggcggcggaagctccatggatacggcgaaagcgatcggggtagaagcgacacacgaaggaagcgtgcttgattatgaagccgcggaaggcaaaaagccgctggaaaaccgcattcctccgctgacaacgatcccgacgactgcgggaacaggttcagaggtcacacaatgggcggtcattacagatgaggaaagagaatttaaattcaatacgggcggaccgcttatcgctgcgcatttaacggtcattgaccctgagctgcacacgtccatgcctccgcatgtgacggccatgacaggtattgacgcacttgcgcacgccatcgagtgctatacgatgaaattcgcgcagccgatcactgatgccgtcgctttaatggccattgaatatgcggcgcattatattaagcgcgcgtttgcggacggagaggatttggaagcaagatacggcatggcgcaggcggcgatgcttgccggcctttcatacggcagtgaatcagcaggcgcggcgcatgcgatgagccagacgctcggcggcatcatccctgtcgctcacggacaatgcgtcgcagctatgatgggaccggtaatggaatacaactggaaaggctatccggaaaaattcgcccgcatcgccaaagcattcggaatcgatacaagcaacatgacaaccgaagaagcggccaaagcgtccgtcaactggatgtatgatcttgtaaaagatttagaagtgccgagtttagaagaacaaggtgtgtctccggacatgattgaacgtttatcaaaagaagccatgaaagatccgcagactttcggaaatccaagagatttgaatgagaaagcatacaactggatttacaaacgctgctttgacttaacgccgaaaacggtataataaatgaaccccgctcctttacagagcggggttttttaaggataatgtcaagaaaaaggcggtggtggctgatgtggaaacgcataacagcaaagacggaaggcgtatatatagcggataccgaacaatttgttaccaaaaagatggacaagcttcgcgcggaatacggcgggtttcccggtgacctgcatttcggactgacaaaaaaggccggcgcgcgtgagccgatgtatgaaagaggaacagaaatttttaaccggagacaaatttcaatcgtgtccatggaggaatgtgatgacattgcggagaagatggggatttctcatatctttcccgaatggctcggcgctaacatcgcaatcagcggtttttctgcgctgacgccgcttaaagaaggaagcagaatgatttttccaagcggtgcgtctctgttgtgcgagggagaaaatgatccgtgcattcagccgggagaagtcattcaatccttttatccggctcagccaaaactcgccgcggcgtttgtgaggcacgcgatgggcagaagaggaattgtctgtattgttgaacgcccgggtgatatatgcacgggcgatgcggtcaccatccattcctatgaaccgaaacgcgccaagaaaaaaatcgagaaggtctgactcagaccttctcgattttttgtttgatttcttctatttgatcgatgtgacgcttttcatgatggccgataaaatcaatccactgccggatcgtcagttcttgaaaaacgggatgcggaagcacacgttcaaaatcttcctcgtttaatgatgaaataactgcggtcagctgctgtcttgccgtatctaattcttgttttgcttcaatgactgagattcggttttgctcaggttcgaggtgtgacggcgccggccgtttatttgatctgtcctctataaactccatcggtttgtcttcgatttttttaaacggtgcgtcttttgcctgctttgataaaagggtctgcgctgtttcgtcaattttctttaaatggtcaaggacttcccgcacgctccactcatcagccgcgggctttcggttgaattcctcatcagagagccctttcagtacttcccaggtctgctgtctggcttcattaaaaatgctcatcctatctcctcctttagagtaaacatatcatatccggattggataatcatgtaatcagccttccttatcagaaaattgaaaccatttacctttacatccgtatataaagtaacactccgacacctcagccgaaaggaggatagaatgtggacatatttcatctgccgtttgaaacggtctatctttacacattgattatttcgggaagtctcacgcttttgattctgttttttcaagatgtgtttcacggcctctcagaagccattcctgtttcatttttaaaccctgcattgattctgtcttttttaacaatcttttcagcctcaggttatatcggcgaaatcgccgctccgctatcaagtcctgtcattgcgttgctttcatttgttctttcggttcttttggtcagcctgcttcacttcttcgtccttgccccgctttcatcagcggaagaatcgctcgcatatcgggagacagatttaaagggcagggtcggcagggtcattacttccgtcccgaaagacggctatggggaagtgatcatagagggaatagggggcgccatttctaaatcagccgtcagctttgatcaagaacagatcagatacggaacggccgtattagtgattgacgtgaaagacggagtgctttttgtgacgccgcatgaaccaatctgatatctaagggggaactgttatgactatgccgattatcattgttatcggaatcgtattctttttactcatcgcacttattgctgtatttattacgaagtaccggacagcggggccggacgaagcccttatcgtgaccggaagttatttgggaaataagaacgtccacattgatgaaggcggaaatcgtctgaaaatcgtccggggcgggggaacgttcgtgctcccggtattccagcaggcagaacctctcagtttactgtcaagcaaacttgatgtctctacacctgaagtctatacagagcaaggggtgccggtaatggccgacggaaccgccattattaaaatcggaggctccatcggtgaaatcgccacagcagctgaacaatttttggggaaatccaaggacgaccgtgagcaggaggcgcgggaggtgctggaaggccatctgcgctccatcctcggctccatgaccgttgaagagatttataaaaacagggaaaagttttctcaggaagtccagcgggtcgcgtctcaggatcttgctaaaatggggctgatgatcgtttcttttacgattaaagacgtccgggataaaaacggctatcttgaatcattaggcaagccgagaatcgcccaagtcaagcgggatgcggacattgccacggcagaagcggataaagagacgaggattaaacgcgcggccgctgataaagacgcaaaaaaatcagagctggagcgggcgacggaaatagctgaagcggaaaaaatcaatcagctgaaaatggcggaatacagaagagagcaggatacagcaaaagccaatgccgaccaggcatatgatcttgaaaccgcaaaagcgcgccagcaggtgacagagcaggaaatgcaaattaaaattattgagcggcaaaagcagattgaattggaggaaaaagaaattctgcgccgtgagcgccaatatgactctgaagtgaagaaaaaagccgatgctgaccgttactcggtggaacaagcggccgcggccgcaaaagcgaagcagctcgccgaagccgatgccgagcagtacagcatcgaagcgatggccaaggcggaagcggaacgcgtgagaattgacggtcttgctaaagcggaggctgaaaaggcgagaggagaaaccgaagcggaagtcatccgcctgaaaggtctcgcagaagcggaagctaaagaaaaaatcgccgacgcattcgaaaaatacgggcaggctgcaatccttgatatgattgtgaaaatgctgcctgaatacgcaaaacaagtctcagcgcctctttcaaacattgataaaattaccgtcgtggatacgggaggaagcggtgaaaacggcggggccaataaagtcacaggctacgcaaccaatttaatggccggtctccaggaaagcttaaaagcatcttccggaatcaatgtaaaagagctgattgagaatttttcaggcaaaggaaacataaaacaaagcataaatgaacttacaaaagaactgagtgattctaacgaacggcacagcccggaataaaaaaacagcaggcgtaaaccgcctgctgtttcagttcgtccgcttagcttcaagaagccgcggcgcagtcatgaataataagataaggacaatggccgaaaggataaaagaaggaatcatgtaagtcgcgttatagacggatgaataaatccagaccggcgtacccttcggagcatagcttccgaaaaagactgctccggagaccacatgcgccgcataccgcagcacactgccggtgaaaacaccgcctataacatacatcgttaaagcgcctctttttttattcaatgccgatgctcgtacaccggaagcgagcaagccgctgaaaccgagaactgcaaatgccgcgatataatcaagaaatagctgcaccgggtgctgcaaaaacaaattgccgatggcgatctggacaatccctgttaaaaagcctgtcgtaagcccggccttcactccccagcggaatgaaatcaaaaaaatcggaatcatcataatagagaccgaacccccttggggcatccggagaaacatgcctgagacaatgtccagaatgacagccgccccggtcataatcgctatttcaattaagcgcacaagctgtgttgaatgattcatagttttccccctggtcagacaaccgtatcaaggataaacaaaaaagcagcgcggggaaggatgggaaaaggtccgcgcgctgcttacataaactgcaaatcatttggctttgccacatccctacgccagcgttaactaacaggttcaaagggtcagaacaaaacgttcactctcagctttaatgctccccttgtggtcatcaagtatttagttcaatcttactatacaagaaaatataccaaaccacaagacagcttatctttctatagaagagaaactgaaataagtatgaaagaaaataattaatgattttttttaaaaaactattgtcatattttcaaaagggtgttatattattaaacgtcgctgatgaacagcagacaacaacgaaaagcttcggaaacaacttaaaaaaagttattgacataaaagaagctgggtggtaagataataaagctgcttcaataagcggtcatgatctttgaaaactaaacaagacaaaacgtacctgttaattcaaagttttaaataaatcgcacagtgatgtgcgtagtcagtcaaactaaggtctgcacgatgcagatcacacagacgttactgcaggatgcagtgaacttagtctgtgttccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatacggaggattagctcagctgggagagcatctgccttacaagcagagggtcggcggttcgagcccgtcatcctccaccattccaatcatacataagttggcgtattaggccggtgtagctcaattggtagagcaactgacttgtaatcagtaggttgggggttcaagtcctcttgccggcaccacttttatatgttatactatataagtctcttgtaataagagccattagctcagttggtagagcatctgacttttaatcagagggtcgaaggttcgagtccttcatggctcaccatgtttttcttgcggatgtggcggaattggcagacgcgctagaatcaggctctagtgtctttacagacgtgggggttcaagtcccttcatccgcattgccaaacgcggaagtagttcagtggtagaacatcaccttgccaaggtgggggtcgcgggttcgaatcccgtcttccgctccaactatactataccatccatgccggggtggtggaattggcagacacacaggacttaaaatcctgcggtaggtgactaccgtgccggttcaagtccggccctcggcacttattgttgcgcccgtagctcaattggatagagcgtttgactacggatcaaaaggttaggggttcgactcctctcgggcgcgccatacatacttttgaaaaacgggaagtagctcagcttggtagagcacatggtttgggaccatggggtcgcaggttcgaatcctgtcttcccgaccactttggggccttagctcagctgggagagcgcctgctttgcacgcaggaggtcagcggttcgatcccgctaggctccacttgattttaattgtttttggcggtgtagctcagctggctagagcgtacggttcatacccgtgaggtcgggggttcgatcccctccgccgctaccattggacctttagctcagttggttagagcagacggctcataaccgtccggtcgtaggttcgagtcctacaaggtccaccacttatacggaggaatacccaagtctggctgaagggatcggtcttgaaaaccgacaggggtgtcaaagcccgcgggggttcgaatccctcttcctccgccatatctaatttaattatcatcgcggggtggagcagttcggtagctcgtcgggctcataacccgaaggtcgcaggttcaaatcctgcccccgcaaccaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttaatttaatattgttttggcggttgtggcgaagtggttaacgcaccagattgtggctctggcactcgtgggttcgattcccatcaatcgccccaaacaacatgcgggtgtagtttagtggtaaaacctcagccttccaagctgatgtcgtgggttcgattcccatcacccgctccatttttatattgtcatgggcctgtagctcagctggttagagcgcacgcctgataagcgtgaggtcggtggttcgagtccactcaggcccaccatgatgatttttccacagtagctcagtggtagagctatcggctgttaaccgatcggtcgcaggttcgaatcctgcctgtggagccatacggagaagtactcaagtggctgaagaggcgcccctgctaagggtgtaggtcgtgtaagcggcgcgagggttcaaatccctccttctccgccataaggcccgttggtcaagcggttaagacaccgccctttcacggcggtaacacgggttcgaatcccgtacgggtcattaaaaaaaccttgcatagtatgcaaggttttttattatgcgttcatagcgtaaatggtaaaagacaggtatgtggcaaaagcgctccataataaataaggaaccagaagccaggctgaagctttactgtatttaccggcaatgagcaacagaatgagtgttgtcacagccacaagcaggcaatcgatagatgcagcaagcaaatttttctgtgtgaattgaaaatagctgaatccttgattcacgatataattgatgagaagcatcacccaaaaagctttggattctttacatgaaaactttgcatatattaaggctgctgagagcgaaataagcgcaaacaaaaccgcccatatgatgccgatcactgatccgcccagcgtccagtcaggtttttgcagcgcgtcgtaccattcccggtcgatgggaaagagaaaccctgctaaagaaaacaagacatatgtaatgataaatacaataatcgcaccgatatacttctttttcatttgttccctccgtcattcaatgtcaatacgttagttccctttcttggaaagattaaaccgttcaaaaggttcatgcaccattaagtgtatgagttttcggtgtgaaaatgcagcaaaccaattatttgtattcaaaaaccccggcctgccggggttttaatcagcatgaaggtcgccaaaggtcgtcataattccttcttcgtccagttcctgctcatatttttcgtgtgccttgcttggatacacggaaatgttttttccggtaatatctgtcgcgataaagttttcataatcctcagcatagccgatgttttcttctgagttcattgtcatatccccatagctgagcggcggatcttctaaatcctgaggcgtttctgagtttccgtatccctcaacatcctgataagcatcttcactatcgtaagccgcccggattgattcatcatcatcaaattcaaactgtccgaacggtgtttcctcttcaatcggcctgtctttggaaacggcatcctgcgaggaatattccgccaatgtcgtagccgtcggcagagcttcaagtctgtcataaggaatgtccttgccgctgacttcacatgtgccgtatgtgccgttttcaatttgtttcagagagtaatcaatatcgcgaaggtgctccctttcatggtcgagcagagccaggtctttttcccgctcgtataattcggtcgcctgatcgccgggatgattgtcataggaagacaattcgccggatgattgatacgggaattcatcagttaactgaaattgatcattttctttaaagcggcttaaaatatcatctctggcttcttccaattctttttttaagtgtgtgatctgttcgtttgtaagcacatcaatccctcgtttctatgtgatgcttactgttagtatgaacgtttttacgcagaaaaatggtggataaaaatagtcattttcccacgaggaagtaaaaggatacagtgattgccgagagtggggaaagaaaattcaagtttgtttctttattcatttgcgcaaaaaggtttataataagaaatgcaggcattttgtcgtgctcaaatctgtgtgtttgacacaaattcatcacaggtgtattgtattaaaagcatttaacggattatggaggaatgtctcatggtgacaacggtgcagcatacgttccgagaggaagcagatcatgcattacataaagccaaacaagtcaaccatgctgtcttattgagctattcaagacgtattgcgtctttagaccctctatcatttttcaaagacggagcaaaaaaatataaaggcaaacgatttttttggtcagaacccggtagtgaattaacaatagtcggtcttggcacagaagcgctgttccaatcgaatgaaaaaaatggaaaacgttatcacgacgtttttgaacaatgggagcgctttaaaaagacggcttttcatattcatgaagaagaagaggcggcgcataccgcggtcggccctgtcttattcggcggtttttcatttaatcccgctgaagagagaggagacgaatggaacgggtttgaagaaggaatgttctttatcccctcactcatgctgacaaagacggcagacggcgattatttaaccgtcaatcaatgggcggcagacggtaatcaggcagaagatacgctgaaacgtctgaaatctttttcagaagcttttgcagtttcttcaattgagtatgaagaatatcctgttttaacaaaagcggaagaacttgatgtggaaaactggcttgaagccattaaaacagcaacaaatgatatgaaggcaaatcaatatgataaagtcgtgctggcaagggaagtcgttttgtcatatgatgggcctattccggcggagagcgttgtccgcaagcttttgacggaccaaacgacaagctatgtttttgcgattgagcagggagataaatgctttgtcggcgcttcaccggaacggctgatcaaaaaatcaggcaaagacgttatgtccacctgtctggcaggttcaattaagcgcggagaaaatcaacaagaagatgaccgtctcggcaaagagctgctgcatgacgaaaaaaatctcgcggaacatgattttgtggttaagatgatacacgattctttcttgtcgagctgcagtgatgtgaaaaagcctgcaggcccgcaattatataaaacaaaaagtgttcagcatctatatacgccgatcacaggcaatctgaaaacgtccgcttcgctgtttgatttaattgaaaagctgcatcccactccggcattgggaggagctcctcagcagaaagctgttgaagttatcgctgatattgaaccgatgacacgcggatggtatgcggctccgatcggctggatggacggcagggaaaacggagaatttgtcgtggctatccgatcagggctgattgaaggcaaaagtgcgcggcttttcgcaggctgcggcattgttgaagattcagatccgcaatcagaatatgaagaaacacaaattaaactaaagccgatgatctctgctttaggaggtgaaaggctttgacaaacccgattacacattatatcggaagctttattgatgaattcgcgctatcgggtgtcaccgacgcggttgtttgcccgggatcgaggtcaactcccctggcggttttggcggcggcccacccggatattcaagtccatatacagattgatgaacgatccgcaggttttttcgcactcggtcttgcaaaagcccgccagcgtccggtcatgctgatttgtacgtcaggaacggcagcggctaacttctatccggccgtgattgaagctcattattcaagagtgcctcttattgtcctgactgctgaccggcctcatgaattgagggaagtgggggcgcctcaggcgattaaccagcattttctgttcggtaactttgttaagtttttcacagactcagctcttcctgaggaaaaacctcaaatgcttagctatatcagaacattggccggcagatccgtaagtgaagccgggaagcgcccgatggggccagtccatatcaatgtgccgctcagagagcctttgatgccggatttatcagccggaccttttgaaagaatgagaaaggggaagcacgtctcagtcacaacagggattcagtcagctgatcaagactctctctgtcatattacagagcgtctcgcgggtaccgaaagaggtatgatcgtctgcggcgaaattcacggtgaagcagaaaagcagcaaatcatcgcgcttgccgagatgcttcagttcccgattttggctgatccgctttcaaacctccgaaacggggagcatgataagacgctgattattgatgcttatgactcgttcttaaaagatgaagaaataaaagaggcgctgcgccctgacgctgtgatccgcttcggtccgatgccggtttccaaaccgctctttttatggctcagagacgatcctgccattgagcagtttatcgtcgatgaagacggaggatggagagatcccacccaggccggcgcgcatatgattcattgccatccgtctgtgtttttggaagcggtccgttcagctgaaaccggaaaacggccgtccggatggcttgagaaatggcaatttgtcaatgaccggttccggagtcatttacaggccgcgagcatggatgatttatcatttgaaggaaatgtatatcgtcagcttcagcaccttgtccctgaaggcagttcgatttttgtcggcaacagcatgccgatccgcgacgtggatactttctttgaaaaacaagatcgttccttccgtgtctatgccaaccgcggcgctaacggcattgacggagttgtctcctcggctatgggactgtgtgaaggtacaaaagctcctgtcacgcttgtcattggagatttatcgttttatcatgatttaaacgggctgttagcggctaaaaaacttggaattccgcttacggttattttaataaacaatgatggcggcgggattttctcgtttttgccgcaggcatctgataagactcattttgaagaactgttcggtacgccgacgggtcttgatttccggcatgccgccgcactgtatggcgggacgtatacttgtcctgagacatgggaagcatttaaggatgcgtatcagccgcaggcggacaagcccggacttcatataatcgagctgaaaacagatcggacatcaagagttcaattccatcgcgatctgctgcaggccgcagtgcgggaagtgaaaaaagaatggaaactgtaacagttaaaacggccgacggcgtatgctatcgtgctgctgatagcggacacggacacgaatcgtctgaagctattgtttgtctgcatggatttacgggcagcaaagaatcatggatgtttttacgcggcatgtttcccggcgagcgaatggtgatgattgactgcctgggtcacggggagacagacgcgcctgtgcaagcggcaaggtatagtgcgagccggcaggttgcggaccttgccgccgtttttgatcaattaaaacttcacaaagtgaaacttattggttattctatggggggaagacttgcgtattcctttgcacaggcatttccgcatcgggtgtcagcgcttgttttggaaagtacaaccccgggcctcagcacgcttcaggaacgcaaaaaacggattcagtcagaccggaagcttgctgactttatattgcgggaaggtgtaacatcgtttgttgattattgggagagcattccgttgtttgccacgcagctttctcttccggacagcgtaaaggcgtccatccgtgccggcaggctgaagaataatccgtccggacttgcaggaagcctgctcggaatggggacaggctcacagccttcctggtgggaggcattacaccgcatcaaggcgcccgtcctgctcatatgcggtgaatgggatgaaaagttttgcgctattaatcaaaaggtgcataacctgctcccatcaagtaaaatagaggttgtcaaacaggcggggcacacggtacatgtggaacagccgcgaatttttggtaagatagtaagtgagtttttatacggcttgtaaagcataaagaaaatagcttttcggccggactcaggcaaaaatgaaggaggtcatatcaatggctgcagaatggaaaagtgaacgtcagtacgatgaaatcctgtacgagacgtataacggtattgcaaaaataacaattaaccgcccggaggtacataacgcatttactcctaagacggtatcagaaatgattgacgcgtttgcttgtgcgcgtgatgactccaatattggtgtcatcgttcttgcgggagcgggagataaagcattctgttcaggcggagaccaaaaagtccgcggtcacggcggatatgtcggagacgatcaaatcccgcgtctgaatgtgcttgatcttcagcgtttgatccgtgtgattcctaaaccggtcgtagcgatggtatcaggctatgccatcggcggaggccatgtgcttcatatcgtctgtgatttaacgattgcggccgataacgcgattttcggtcaaaccggcccgaaagtgggtagctttgatgccggttacggctcaggttacctggcgcgtatcgtcggacataagaaagcccgtgaaatctggtacctgtgccgtcaatacaacgcgcaggaagcgctcgacatggggcttgtcaatacggttgtcccattagagaaacttgaagaggaaacaattaaatggtgtgaagaaatgcttgagaaaagccctacagcccttcgtttccttaaagcggcatttaacgctgatacagacggcctcgccggaattcagcaatttgcaggagatgcaacgcttctttattacacgactgacgaagcgaaagaaggccgtgattcctttaaagagaaacgcagtcccgatttcggtcaattccctcgttttccgtgatcagatgacactacgaaacagcttgagccgctctggtccaagctgttttcttttcaaaaacagtacttttacctcggagatgataacatgctgacagaacagccgaattggctcattcaaagggctcagctgacaccggagagaatcgctctcatatttgaaaacaaacagatgacattcagagaattatatcatgcttctaaacaaatggccgcgcggctgtccaaatactgctcgcttaaaaaaggagacagggccgcgattttgctttctaacagaccggaaatggtttatgccgttcacgcctgcttcttattaggggcggaagctgtgctgttgaatacgaagctctcaaaacaggaacggttgtttcagctcgaagattcacaggcaaagcttttattgacggaggacggtttttgccgcgaagaatatgaatctgcggtcgccaccgcagatgtggacgagctgcaggctgaagaggcgggtgacatggagccggaagcttatgtaacgcttgatgatacggcgactcttatgtatacgtcaggaacaacaggaaggccgaaaggggtgcagcagactttcggtaatcattattccagcgctgtatcgtctgcgctgaatctgggggtcacggagcgggaccgctggcttattgcgctgccgctgtttcatatcagcggtctgtctgcgctgtttaagtcggtcatttacggcatgcccgtcgtgcttcatcaaaaattctctgtcactgatgtgctggacagcatcagctcccatcaggtcacgatcatttcagcggtgcagaccatgctctcgggcctgcttgcggaaactgaacaatgtcctgaatcactgcgctgcattctgcttggcgggggtccggcaccgctgccgctccttgaagaatgccgcaggaaacaatttccggtattccaatcttacggcttgactgaaacctgctcacagattgtcacactttctccggaattcagcatggacaagctcggctcggccggtaaaccgctgttttcatgcgaaattagaattgaaaaagacggaaacccttgtgcgccgtttgaacatggtgaaattacggtgaaaggcccgaatgtaatgaaagggtattatcatcgtgacgacgcgaaccaggccgcttttcataatggatggttcaaaacgggcgatcttggctatttggatgatgaagggtttttatacgtgctggacaggcggtcggacctcatcatttcaggcggagagaacatctaccccgcagaagtggaagcggcgctgcttgcccatccggctgtagcggaggccggtgtttcgggagccgaagatccgaagtgggggaaagtgccgcatgcttttctcgtgctgacttcttctgtcagttctgaggagctgaccgccttttgccgtgagcggcttgcaaaatataaaataccagctgcttttttcaaggttgacgggctcccgcggaacgcgtccaataaactgatgaggcatcggctgaatgagcttcgtaaaggagaattgtcatgattaagattgaaaaaatcaccctttatcatgtaagtatgaggctgaaaaaaccgtttaaaacaagtattgaaacgctgcaggatcgtaaatttttgatcgtggaagcgatcgacgaaaccgggagaaccggctggggggaggtatcggcgttttcttctccgtggtatacagaagaaacgattcagacatgcgcgcatatgctgagagattttttcatcccaaatgtcgtaggccgcgcgtttttccatccgtcagaagtgcctgacagtctcgcgcgtttcaaaggaaaccgcatggcaaaagcggggcttgaatcagccgtgtgggatctatatgccaagaaaaaggggatatctctcgcagaagccttagggggcaaaagagataaagtgcccgccggcgtggcggtgggtctggcttcggctgatgagatgcttcgggaaattgagcaatacgtaaaagaaggttatcaacgtataaaaataaaaattcagcccggccatgacgttgatctggtcagagccatccgcagccgttttccgaacgtgccgctgatggcggatgccaactcggcttatgaactgaaagacatcagcaggctgaaagagttggatgaattccagctcatgatgatagaacagccgcttcaggcagatgatattgtcgatcaccgccacctgcagaaacacttaagaaccgcggtatgccttgatgaaagcatatgctcttatgatgacgcaaggcgggcgattgagcttgggagctgtaaaatcattaacataaaaccggcgcgtgtaggaggcctgacagaggcattaaaaatacatgacttatgcagagagcatcacatgccggtttggtgcggcggaatgtttgaaaccggcatttcgagagcgcagacagtcgcgcttgcttcgctgccgcaatttacgataccgggtgatatttcctcatcagaccgatactgggaggaggatattgtcactcccgatatccgtatcgaagagggattcatctctgtcccggacggtcccggactaggtgttgaagtcaatcaggaaataatgagaaaatacgtcacccaaatggacgtttttacgacaaacaactgataaaaagacatttcagcgagttgagctgcctgtacgctgctgttatattgaagctgttcattatcaccccttcccccgtttgaaccggctgtatcagccggtttttttaataggcggatgcgatgatttttttattcttcaaacagtgccggctttacaacgcaggtgctgctttccggctggggcaaacatgtacatcttgataaaaaattctgagcttgtcatgaatgcgatactgattgtaccgtctgccgcctatatttgccgccgaaccgcctttttgccatgcttctcatccgcgcggttttctccggctcagggaggcttgcggcggaaatgaaaaagagctgtataaaacagctcttttcttttataaatcttgcggtttaaaggttttgcaatccgtttcttcacttttttcagcggtttcgcctgtatggctgaccacataaatagcgtcggccgtgcatttgtttcctctgccccaatatgaacagttattgacttcacacagaattttttggtccatgctggctcccctccaagataaaaggtacgccattagtatgagccgccctgatttttgttattcctcctggcggatataacgtctgtctttcataaagagcttccagaagaaataaaacccggggaacaaaatgatgaaagcgacgatatacgtcataaacagcgccctgaaggttgccggctccgtaaatcctgacatgaccgtaatatccggataaatcatataaggaagatgagcccgtccgtatgcatagcttgccagaaagtattggagcgcaatggcgatcatggcgattctcggtttgccgaggttgcggccgaagcgcttattcggcaaaaacagagccacgccggcaatgataaatgtaatgacagacagaatgagccatgtcttgtctttcatcatccccgtatacagccagccggcttcagagcgtaatgtcagcataatgaagaaggcaaacagaagcgacagcggccctgttattaaagagctccgtctgtagatgcggtacgcatgctcctcttccgcaacatttgaaaaatcggccagaagcagtgaagataaaaataaagtgcttaaaatggcaaagccgataaacgcatacgcattaagacttgtaaagacatttgccaaattcaggtgatacactccgcccgtcttctcaataaaccctccgtgtgtgaccggaaggaccaaaatcagcacagcgggaataatgaagcctgaaattccggagatatatctcatgatttttctttccttcgccgtattggagaagacgagaaagccgctgcggatggctaagagcagcaaaataatacttcccgggatcaataaaacggttcccagcacgaaggttgcccctggaaagaagctgaatagggcgacaacgatcgcgacgataaagacgttggtcacttcccatgtcggggacaaataacggttggcgatgtttgtcgcctttgtttgttctttatttaaatatatcatcgaccaaaagccggctccgaagtccatcgttgccatgaccgcgtagataaacacgaagccccatacgattgatatcgcaatgagagcatccatggtaatgtccatttcaattcagccctttctattgttaggattccgccgcttttacatcctcctcaacaggatgtttgcggaaataataaagcagcacataaatgactgcggctgccaaaatggcgtaaaccactgtgaacaggatgaacagcaaaccgattgaaccggttgtcgtgacgacatcagacgttttcaggagatggtaaatcacccatggctgccgccccgtacaagcgaatatccacccgaattcaattccgatcagactgagcggtcctgcggttaaaaataaaatcaaaagccaagtcggaaagctgtctttctttaaaatttttctccacacgatgccgatgatggagtacaaaatgagcagcatcccgatgccgaccattccgttaaacagtgtatggatgaataaaggcggccactcgtctttcggaaacgcgttcaatcctttgacgacggtatcaaagctgtttgcggccaaaaagcttaaagcccacggcacttctatcgcccattttactttttcttcttttgcatcagtaaaacccccgatcgcaagcggagcgtgtgatctagtttcaaacagcccttctgcgcccgcaagcttctcaggctggtattcgtaaagaagctgggctgactcgtgaccgtttaaagaagcaataatagagaatatcccgccgatcgttaaagcgagcagcagcgcttttcggtgaaagcggtatacctgctcctgttttctcgttctcagcattttataagccgcaactgacgcgacgataaatgcaccggtcatgaaagccgtcagtacgacatggcccgcggtggtgaaaaagcttggattaaaaaacgctgcccacggttcgacgtcagtgattttgccgtttaaaattttaaagccggccggcgttccttcaaatgcgtgaacatttgtgattaagacggcggatgccgcggcgccgatcaaaacgaaaataacggcaatgatgcgcatcgccggagtcagccggtcagcggcgtagacataaatggacataaacagcgcttcgataaagaaagcataaatttcaatctgaaacggaagtgacatcaccctgccgatgatctccatgaatccgggccacaaaagggcaagctgtgtacccgcgatcgttccggtcggtatcgccacgccgagcagaacagcctgcgccttcgtccaccttttcgccataatggcataatgcggatcttttgttttttgataaatcaattcggccattaaaatcatcagaggcaagccgacaccaagcgtcgcaaaaataatatgaaagcccatggttgtcccgaacagacttctggctaatactaaatcatccacgatcataaaccgcctttctaaattaccgttttatgtaatgtggttatattatttgctgaagcgattagattattcttccgattccatatatgtgcagggtttagaaatcaagggatcagggcatatatgattgacaagcgcctatttaaggtttagaataaaacgtaattattacgatttaagaaagggagatcaccatgaaaaaagatattcatccggataaccaccaagtgatttttcaagatgtgaacagcggctaccgctttttaagccattctacgaaaacgtcagaggaaacggcagagtgggaagacggaaaaacatacccgctgattaaagtggaagtcagctcagatacgcatccgttttatacgggccgccaaaaattcaacgaaaaaggcgggagagtcgaacagttcaacaaaaaatacaatatggggaaataagacaagcccaatagggtttgtcttatttattgagcactttatcatctcgtgcggggagtgacgaaatgacccgccttatgttatattgtgaataaaaaagcagaaaggaaacaccaagatgagtcttctaaacgatatcatgcaatttaatgagcagttcactaaaaacaaagattatgaaaaataccaaacatctaaattcccggataaaaagatggcaattttgtcctgtatggacacacgtcttgtagaattgcttccgcatgcgatgaacatgcgaaacggcgatgtgaaaattattaaaagtgccggcgcgcttgtcgcccacccgttcggaagcatcatgcgcagccttttagtggccgtatacgaattaaacgctgatgaagtctgcgttatcggccaccatgattgcggcatgagcaaaatcaacagcgaggatatgcttgataaaattatcgaccgcggtattccgaaagagcggattgacatgctgaagcactcaggtgttgatcttgatcaatggctgaaaagctttgattcagtagaagcgagtgttacagacagcgtaaacgtcattaaacaccatccgctattccctgacaatgtcccggtgcacggtctggtgattgatcctgaaaccggtaaacttgatctggtgatcgacggctaccagcatatggactaatgttttcgttttttgtccggtacgggatcaacaccgcccggatgaaaagggtggcactttaaaatccgcttcagtgtcagccatccgccttttaatgcgccgtgagtcttgacggcttcgattccgtactgtgaacacgtcggataaaagcggcatgacggcggcgtcagcggagagatgaacttctggtatccgcggatgagcgcaatcattatggttttcattaaaaaaccacctttctgatgctagtatagaaaaaaaatttcagattgaaaagctttcgccacaattcttatcggaaaactgtgttataatggatgcatattctgaaaaaaagggagtgccattatgccttcagtagaaagttttgagctagaccataatgcggttgtggctccgtatgtaagacattgcggagtgcataaagtcggaacagacggcgtcgtgaataagtttgacattcgcttctgccagccgaacaaacaggcgatgaagccggatacgattcatacgcttgagcacttgcttgcgtttacgattcgcacacattctgagaaatacgatcacttcgacatcatagatatctcaccgatgggctgccagacaggctattatcttgttgtcagcggcgagcctacagcggaagaaattgtagacctgctagacgctacgctgaaagaagccatcgatattacggagattccggcggccaacgaaaaacagtgcggccaggcgaaacttcatgatttagaaggcgcgaaacggctgatgcgtttctggctgtcacaagataaagaagatttgctgaaagtgttcggataaaaaacaggcctttttgctgacatgcaaaaaggcttttttacatatttctaaaaaatgtcacaccttatgtgtaagcgtttgctaaaatagaagcaaacatgaaggagtgatgggatgaaacgggctgtattggcaggtatgtgcggtatggtatttctattatcttcctgcgggggcaattcggacaaaaccgccgcggatgaggagcctaaagcgcttgaggtcaagcttacaggaccggaaacggcagcaccgcatgaaaaaacggaatacaaggcggaggttttttacggcggcaagcgtgtcacggatgcggatgaagtcatgtttgaagtatggaaagaaggaaaaaaaggcagcagcaaaacaagcaaggccaaggaggaaaaaggggcgtatcacctgcggactgaatttgatgaagagggtgtgtataccgttcaatcccacgtaacggcaaaacagcagcataatatgccgactgtaaaagtacgtgtcggggatgctgaagctgccgatgattcctccggccatgaggaacagacgcatcatcattaaggattgtttttatccgtcaagccttttgatgcgtcctccggcgggtcaatcgtatgttttacgttataagctcttacagtcgaccagatggataaaagcagcacggcgagcacgataagaaagccgaagctcagaagaagcagcatgaaatccctcctttttaacaaatcataacatattttccatccgtaaaatcaagggctaaaaatttatgttttaacacacgatatatagggtatatcaatagtaaatcaaaggaggaagataggcatgtcagaaaaactattggaagcggtcaataaacaagttgcaaactggacggtcatgtatgtgaaattacataactatcattggtacgtcaaagggaaggactttttcacattgcacgaaaagttcgaggagctgtataacgaaacggctacatatattgatgatctggcagaacgtctgctggcattgaacggcaagccgatcggcacaatgacggaatcattgaagagtgcttctataaaagaggcggaaggcaatgagagcgcagaacaaatggtacagaacatttatgatgatttcactgtcattgcggaagagctgaaaagcggcatggatctcgcagatgaggtcggagacgaaacgaccggagatatgctgcttgccattcaccagaatatcgaaaaacataattggatgctgaaagcgtatttaggataatcaacaagggaagaccggggctataaagcactcggtcttttatttggctgccgaagagaggtgttgtccatttttctgaaaaatccagtccgttccattcacttttcatagaataatgtaaggccgtttctgtgaaaggatgttggatcaagtgggcaaagactttggcatcttttcgttttttgcagtgatcgtgtcggcagcggggtttttctttggcggttttcagtattcgtttctgattttgctatcggtcatggcgattgagtttatcagtacaagcttaaaagaatctcttttgcagcagctgagcgcaagaaagctttttgcgcggctggtcaaaaaaatcgtgaccctggcattagtctcagtttgccatttttttgatcagctgcttcattcagaaggcgccatccgcaatttggctattatgttttatatcttatacgaatcggttcagatcgtgattacggcaagctcgctgggcatcccggttccgcaggtgctcgtcgacctattggatactttgaaaaataaattcaagcgcaaaccgtaacatttgcttcaaaggaggctatactagcgggtatgatggttttcctctgaatttttgataaagggcttccgaacaaacgcaactgtggtatgatgtatggaagatatgaaggaacggattagagggataaacatgtacgagtttaaagactattatcagaatactgttcagctctcctttgaacaccagcctttttcagacagcccgaagcatgtatgggtcatatgccgatatggagataagtggcttttgactgagcacgaagaccgggggtttgaatttccgggcggaaaagtggagccgatggaatgtgcggaggaagcggccctgcgcgaggtgaaagaagaaaccggcgccgcggtaagacatctgaagtacgtcggacagtataaagttctcggcagggaaaaggtaatcgtgaagaatatttattttgccgatattgaaaagcttgaaaaacaggctgactattttgaaacaaaggggccggtgctgttcagcgaactgccggagaatctcccccgaaataaaaaattcagtttcattatgaaagattcggtgcttccgatcagtctgaaaaagctgaaagaggacggcgtatttcaatcataaaaaacggagacccggcgcttacgcacgggtcttttttatatttttcctttcgtccattttctttctaacagttcgactccctgatacatcaatgtcgcaaaaatcgcgatgatcagaaggcttaagaacacaagagtgaaattgaagacctggaatccgtaaatgatcatgtagcccagacctttttcggaaacgagaaactcgccgacgatgacaccgacccaggataaaccgacgttcactttaagcgcggaaataatcgcgggggcgcatgccggcagaatgacttctttaaacatgatgcttcttttcgctccgaaggttttcatcaccttaatatagttttcatccacttcctgaaaagccgtaaagacgacgattgtcgtgataatgacactgatgactgctcccatggcgacaatgcttgtgaaattcggtccgagtgccacgatgagaatcggtccgagtgcgaccttcggcatcgcgtttaaaatgacgaggtacgggtctaaaacccgggcgagtctgtttgaccaccataacagagcggcgaggcatgtgccgagaagcgtgccgagcaaaaagccgagaacggtttctcctaaggttacgccgatgtgcgccgcaagggatccgtccgcaatcttttcaactaaaagcctgcaaacggcggagggtgagctgaagattaacggatcgatccagcccgccctgctcgatatttcccacccggcaaaaaatacgatgaaaatggcggcctgatacgcacggatccggagcttttctttttggtgtcttttcttaaactgctgatgaagctgttcaatcgtgccgctgctgtttttcaagggaattcagctccttccatatggtttgaaacagcggctgaaaggccggatcctgacgcgcgtcaaacggatctaaagccgcgagctccttaggcacggtgaatatttggtggatggtgcccggctgattcgaaaataaatagatcgtatcgctcatggcgatggcttcaccgatatcgtgggtgacgagcacggcggttttttgaaaatcctttaatgttctgaagacaaggttttccaaagaaagcttcgtttgaaagtccagcgcggaaaacggttcatcaaggagcagcagtccagggtccggcgcaagagttctggcaagtgccgcccgctgccgcattccgcctgagagctctttcggatatttcttttcaacgccgattaatccgagcttaggcagaaggctgagaacttcagctcttttttcttctgttaatgtttttgaaatgtgtaaaccgagcagcacgttttcctcaatcgatttccaaggaaataaataatcctgctgaagcatataaccgatttggtgttctttatggttcggcacgcttccttcgatcagcacccggccttgcgcaggggtgataaggccggccagaatggacaggagtgttgtttttccgcatccgctcggcccgagaaaggagatgaaatcccctttttcaatctgaaaatgtatatctttcacggcggttgtcttttctttaagcgagaaataagtatgtgttacatgatccacatgtaaaaaagacattcatgttcctcctattgttctgaggtgacttttttggcgatttttgtgttgacgagtttgctgtacggaatgtgtttcgggagctctccggcttcatccataatagattgaagcagttcccattcatccttttgcagaactgggtctgcagagaatgacttttgttttttatagcgctctatcgatgtttcgataatggccgggtctgtatcggcaaattccttctgaatcgtttttgcgatgtctttggccggatggctttccacccattgctgggcgcgatagatggcgcgggtgaatttttccgccgtcttttcattgtttttcaaataactttcttttgccataaaggttgtgtatggcacttggccggaagcttctccgaaggatgcgacgatatgaccgatgccttctttttcaaattgggatgccgtcggttcaaacagctgcacataatcacccgttccggatgcgaatgcgttggaaatattggcgaaatcaatgttttgaacgaggttaatgtcttttttcggctctatgtgattctttttcaggacgtactcaccggccatttggggcatgccgccttttcgctggccgagaaatgtttttccttttaaatcgttccatttgaatgatttctcatccttccgcgacacgagaaatgtgccatccgtctgcgtcagctgcgcgaaattgatgaccggatcttttgctccctgcgcctccacgtaaatggatgtttcagaaccgaccagcgcgatgtctgacccgtttgacaaaagcgatgtcatcgttttgtctccgccccatgttgtttgaagtgacacttggagcccttcttttttaaagaaatcttttgcttcagcgacatacagaggcgtatagaagatggagtgtgtgacttccgccacctttaccttcgtcagactttcttcctgtctgcaagccggaagaatgagcaggaaaaaggcgcatatgacaaaaacgcagcccgctttgagccatttgttcacggtgtaacctccttgttttaagcgttaaaataaccttttctgctttacatatcgtatgatgggtataaaaaatgtgtgagtgcccatattcacgttgggaaagaataaaaaaactgatgatctaaggaggcgcattgttttgctggtagaaaagaaaaggttcccgtctccgagtccgcatgtccgcctctttgcggtatgctatgagtcagaagggctgaaggtaaaggggctccttgccgagcctgcggcgccgggaacatatgacggttttttatatttgcgcggcggcataaaaaatgtcggcatggtacgccccgggagaatcgttcaattcgcttcccaaggctttgtcgtgtttgcgccttattacagaggcaaccagggcggcgagggaaatgaagattttgcgggagaggacagagaggacgcgttttccgctttccgcctgcttcgggagcatccgaacgtcagggaagggcgggtgcatattttcggtttttcccggggcggaatcatggggcttttgaccgcgattgaaatggggcatcaagcggcttcactcgtttcatggggcggtgtgagcgatatggtgctgacttatgaagagcggaaggatatgcggcggatgatgaagcgggtgatcggcggcacgccgaaaaaggtgccggatgaatacagatggcgttcgccgtttgaaaaagcagaccgcattcaggcccctgtgctgctcatccatggagagaatgatgaaaatgtttcgatcgaacacgcccggatgatcgaggacaagctgaaagaggcggggaaaccggtggaaacttggtattacagcggttttacgcattattttccgccgcaggaaaacagacgcattgtccggcggctggcggaatggatgaagacacggtaagatgcctgatttatgatatgataataaagaataagagaatgaaaggggattttcattttgggaatgcctgttgaatttaataccatgattgtgacaaaaggcaatgaaaaacggatagaggaaaatatctttttattggagaaagagggctaccgcgtctatcctcttgatattccgatggacgtgcgcaaaacgaaaaccggcgagaaatccggcaccggcgaggtccagaagctcgaatgggcgaacggccggacaagcattacatacagactcacttcgcttcattcgacaaactgaaaaaacaaaagccgagggcataaacgcccttggcttttttgattacacgagaggtccgccggttttggcaatcgagtctgcatgggaaaactttttaaagttttctttaaactcattggctaaaaacagcgctttttcgttgtatgcttgtttatcgctccatgtgttttcaggctgaagaacttcatccggcacgcccggaacatgaacgggactgtgcaggccgaaaatgctgtctgccgtcatgtcagtctggttcagtctgccgtcaatagcggccttgaccatcgctcttgtatacgaaagtttcatccgttctccgactccgtaccctccgccggtccagcctgtgttgaccaggaagacttgaacgccgtgttcgtcgattttacgcccgagcatttcggcatatacatgcgccggaagcggaaggaacggtgaaccgaagcacgtcgagaaagtcgtttgcggagatgtcacgccgcgttcggttcccgcgagtttactggtgtatccgcttaagaagtgatacatcgcctgttccttcgtcagtttgctgatcggaggaagcacgccgaatgcgtccgccgttagaaagacgatcgcctgcggatggccggcaatgctcggctgcacgatattgccgatcatctcaatcggatatgcggctcttgtgttttccgtgtagaaggaattgtcgtaatccgcttcacccgttttttcatcaagcacgacattctcaagaacagacccgaagcggatcgcacgaaaaatctgcggttctttttcctcgctcagattgatacatttagcgtaacatccgccttcaatgttgaaaacgccggaatctgaccagccgtgctcgtcatctccgatcagtttgcggtccgcatcggctgaaagcgtcgttttccctgtgccggaaaggccgaaaaacagggcgacatcgcctttttcaccgacgttggctgagcagtgcatcggcagtatatcctgctgcggaagcaggaagttcataatggagaatattgattttttcatttctccggcgtattcggtgcccccgattaaaatgacgcgcttttcgaaagagacaatgataaatgtttccgaatgcgtgccgtccgtctccgggtctgctttaaaatgcggagctgagagaatggtgaaaggctgcgcttgcgggtctctttcatccgtttccggtctgataaacagctggcgcgcgaataaattgtgccacgcaaattcatttacgaccgtaatcggcagtctgtatttttcatccgctcccgcgaatccttcaaacacaaacagttcatcccgctgttttaagtagctgacgactttggcgtacagcttttcaaacgcctcttcagaaatgggctgattcaccgcgccccaatcaatttgattttctgtgctttgttcacggacgataaatttatctttaggtgaccggcctgtatatgcgccggtagtggcgcgtacggcgcccgttgatgtcagcgttccttcatttcggctgatcactttttcggtaagttttggagccgataaattatgatgcacattcggacttgcaagtaatgcttgaagatctgcggttaaatcaactaatttcataaaaaccttcctttgccggtttatttgtatttcgctgaatgtggaattagtataacatatatctgaaaatagtctatactatttacggttttttgtttgtgtttttccattgcttcccgaaataaaggcgcgcaatcgctttaattcatattgacactttccgcccttttacgataagatatttcattgagcggatactcttatcccgagctggcggagggacaggcccgatgaagcccagcaaccggtttctctgtaaaaaagcaggtgaaaacactgtgggaaaccaaggtgctaacctgatgcaaggtttaatattttccttgagcgataagagtgaaaggcacacagaccaaaccctttcctcgagtggaaaaggtttttttatttcataaaatatgccaattaacattctctgatatagtatgacattgtattaagagggagcgagttccgtatcatatgagaaggtcttgcaaaagatcttttttcaggaggaaaagtgaatgagtaaaaaccgtcgactatttacatctgaatctgttactgagggtcatccggacaaaatctgtgaccaaatttctgacagtatcttagatgagattttaaaaaatgacccgaacgcgcgcgtggcctgcgaaacatctgtaacgacaggacttgtgctggtaagcggagagattactacgtcaacatacgttgacattccgaaaacagtccgtgaaacgattaaagaaatcggctacacacgcgccaaatacggatttgatgcggagacttgcgctgttttaacatcaattgatgaacagtctgcggatatcgcaatgggtgtcgatcaggcacttgaagcgcgtgaaggcacaatgagcgatgctgaaatcgaagcaatcggagcgggagaccaaggcctgatgtttggttatgcgtgtaacgaaacgaaagagcttatgccgcttccgatctctttggcgcataaactagcccgccgtttgagcgaagtccgcaaagaagacattcttccgtaccttcgccctgacggcaaaacgcaagttaccgttgaatatgatgaaaacaacaagccggtccgcatcgacgcgatcgttatttcaactcagcaccacccggaaattacgcttgagcagattcagcgcaatctgaaagagcatgtcattaaccctgtcgtgcctgaggaactgatcgatgaagaaacaaaatacttcatcaaccctacgggacgtttcgtaatcggcgggcctcaaggtgatgcgggtcttacgggccgtaaaatcatcgttgacacatacggcggatatgcacgtcacggcggcggcgcattctccggtaaggatgcgacgaaggtagaccgttcagcggcatacgctgcgagatacgtagcgaaaaacatcgtggcagcaggtcttgctgattcttgtgaagtgcagcttgcatacgcaatcggcgtggcacagcctgtttctatttccatcaatacatttgatacaggaaaagcttctgaagaaaaactgatcgaagtcgtacggaataacttcgacctgagacctgccggcattattaaaatgcttgatctgcgccgcccgatctataagcagacagctgcttacggccacttcggacgtcatgatgtggatcttccttgggagcgtactgacaaggcggatgcgcttcgcaaagaagcactaggagaataattttatagccgcttacttaagcggctttccctttttgtagatgctgccatgcttattttttacatagcgtgaaaccaatggcgtaacaaagcgtctataaaaagggggtccaattagaaaattacacttatggaggctatactatgtgtggatttgtcggtgtttttaataagcatccattaactcaaaccgcagatcaagaagagctaatcaaacaaatgaaccaaatgatcgttcaccgcggtcctgacagcgatgggtattatcatgacgagcacgtcggattcggcttcagacggctcagtattattgacgtagaaaacggcggacagcctttatcatatgaagacgaaaaatattggatcatttttaacggcgaaatctataactacattgaattgagagaagagcttgaagcgaaaggctacactttcaatacagattccgataccgaagtgctccttgcgacataccgtcattataaagaagaagccgcttcaaagcttcgcggaatgtttgcgtttttaatctggaacaaagctgaccgcgtcatgtacggcgcgagagacccgttcggaattaaaccgctgtattacacaaccatcggggacaaagtatattttgcatctgaaagaaagagtttaatggccgctcaaaacggtattgatcttgatacagcttctttacagcaatatatgtctttccaattcgttcctgaaccgagcacgcttgacgctgaagtgaaaaaagtcgagccgggcagccagtttacgatccgcccggaaggcgacatcgcgtttaaaacatatttcaaagcgaacttcaagcctgttcagtctgatgaagataaattggtgaaagaagtcagagacgcaatctttgactctgtcaaagttcacatgagaagtgacgttcctgtcggttcgtttctatccggcggtatcgactcttcttttatcgtttcagttgcgaaagaatttcacccgagccttaaaacattttccgtcggttttgagcagcagggctttagtgaggttgacgtagcgaaggaaacggctgccgcgcttggtattgaaaatatcagcaaagtcatttctcctgaggagtatatgaacgagcttccgaaaatcgtctggcactttgatgacccgcttgcagatccggcggcgattcctttgtactttgtcgcgaaagaagcgaaaaagcatgtaacggtcgcgttatccggggaaggcgcggacgagctgttcggcgggtacaatatttaccgcgaaccgctttcgcttaaaccgtttgaacgcattccgtccggtctgaaaaaaatgcttcttcatgtggcgtccgtcatgcctgaaggaatgagagggaaaagcctcttagtccgcggctgcacaccgcttgaggagcgctatatcggtaatgcgaagatttttgaagagcccgtgaaaaaacagctgctcaaacattacaatccagagctttcataccgtgatgtcacgaagccgtactttacggaaagccgttcatacagcgacataaataaaatgcagtatgttgacatccatacgtggatgcgcggcgacatcctgttaaaggctgacaaaatgacgatggccaactcattggaactgcgcgtgccgttccttgataaagtcgtgtttgacgtagcttcaaaaattccggatgaattgaaaacgaaaaacggcacgacgaaataccttctgcgcaaagctgctgaaggggtagtgcctgatcatgtgcttaaccgcaaaaaactcggcttccctgtgccgatccgccactggctgaaaaatgaaatgaacgaatgggttcgcaacatcattcgcgaaagtgaaacagacgcttatattgaaaaggattatgtccttcagcttctggaagatcattgtgccgacagagcggacaacagccgcaaaatctggaccgtgctgatcttcatgatctggcacagcatcaatgtcgaaaaaagactggtgccggaagagctgaatcatcagccgaaagaagtcattttcgtttaatccaaaaggctttcgagttatcgaaagccttttttctattgttttttgtaaaccgtctattccgctctgttttcgacaaagtattacgcaatattcagaaaaaggttataataggactaatcgggtagattccggaaaaagttttctggctatttcgtctcggtttgttgtttctttgtcaaaatcagggggagggagagttatgcaaaacaaagaaaaaacgcttcaccgcggcttggaagagcggcatatctcgcttatgtcgttgggcgccgcgattggagtcgggctgtttctcgggtctgcttctgccataaagcttgccgggccggggattttagccgcttacgcctgcagcggactgattatgttttttattatgcgggcattgggggaaatggcgattcaaaagcctgtagccggttcattcagccggtatgccagagattatatcggcccgcttgccgggtttttaacaggctggaattattggtttttatgggtcgttacctgcatggcggaaatcaccgcggtcggcatttatatgggctactggttccctgacgtgccgtcatggatctgggcgctttgtgcactcgtcattatgacggctgtcaactttctggcggtcaaagcgtacggtgagcttgaattctggtttgcgctcattaaagtcttggcgattctgtcaatgatcgcgatcggtctggtgatgatcgtattcggtctcggaaacggaggcgttgcgctcggaatcagcaatttatggagccacggcggctttttcccgaatgggattaaaggggtgctgctgtcgcttcagatggtcatgtttgcttatctcgggattgagctgatcggtgtcacagccggtgaggtcaaaaatccggaaaaatcactggcgcgggccatagatactgttttttggcgcattctcattttttacgtcggagctttgtttgtcattatgtcaatttatccgtggcaggaaatcggttcaggcggaagcccgtttgttttgacatttgaaaaaatcggaatacccgctgcagccggaatcattaattttgtcgtattgacggcggctctttcttcctgcaacagcgggatcttcagcacggggcgtatgctgttcaatctggcggagcaaaatgaagcgcctaaagcatacggtacggtcacaaaaggcggtgtgccgggaaaagcggtattggtttcagcgggtgcgttatgcatcggcgttttgctgaactacgtggtgccggcgaaagtgtttacgtgggtgacgagcattgcgacgttcggagcaatttggacatggtcgattattttgctttcccaaatgaaataccgtaaaagcttacagccggaagaacggaaaaaactcaaatataaaatgcctttataccccttttcctcatatatctcgctggcatttctggcttttgtcgttgtgctgatggcttttgatgcagagaccagggtggccgtcatcatcggtcctgtctggttcggcatattattagccgcctattacggcaaaggattccataaaagaaaagacatagatctggaaaacggacagacattcgccgaaaaagcgtaaaaaagagcccgctgaaatgggctcttttttcataggatcgggtaaaagggggaagaataaaacaaattcctgaacattttgcttctgtttcctgacaatcgggagaatgcaaatggtttttacttaaataatattttgaaaaatggtacagtagtaaaacaaagctgatcttttttatttctcttgcattgttttatagtatcggcctttttcaacatattccgttctgattctttccatgtcccgtatgtcttcttctgtcagccggcggataacctttgcgggccggccgaacgcaagacagccgggaggaatggttttgcccggaggaacgagacttccggcgccgataaacgcgccttctccgatttccgccccgtcaagaatgacggagcccataccgattaaagcattctttctgatgattgcgctgtgcagtgtaacctgatggccgatcgtgacgtcatcttcaataagaagcgggcggttcgggctttgatgcagacagctcaagtcttgtatgctgactctttttccgatccttgtcggcgcaacatcccccggatgactgccgagaaccaaatgctcgattgttctccgatcacgacgtcgcccgttatgacggcgttatccgcaatgaacgcttcaggatgtacgtcaggcgtaaattgtttataagggtagattatcatgtctcatccttctttctctaaatttatgtaagaggtgaactgcatgtggacttggaaagcagacaggcccgtcggtaccattgtcattatccacggggcgagcgaataccacgggcgttataaatggctcgttgaaatgtggagatcttccggatataacgtggtgatgggcgatttgcccggtcagggaacgtcgacccgcgcccgagggcatattcgctctttccaagaatacattgatgaagtagatatatggattgataaagcgagaacgcttgaagcgcccgttttccttttgggccacagcatgggcggactgattgcgatagaatggtttaagcagcagagaaatccccgcattacggcactcattttatcatcaccttgtctgggtctgcaaataaaagtcaataaagtccttgattttgcgtctaaaggactgaacgtcctcgctccgtccctcagagtggattccggcttatcacctgatatggcaacgaggaatgcggatatgattgaagcggatcaaaacgattctttatatgtcacgaaggtatccgtaagatggtacagagagcttttaaaaaccattgatgccgctatggtgccgactgatgcgtttttaaaggtgccgcttttgcttatgcagggcggtgatgacaaaatcgtcgataaaatgaaagtccgcaaatggttttccggtgtggcttcccataataaatcgtaccgggaatgggaagggctttatcatgaaatatttaatgaacctgaaagagaaactgtgtttaaggcggcaaaagcctttacagatcagtatatttgaattcgctgggggtgcatatgttgacagtaccggaacatccttttaaccttatggcaaaagtgtatcgggaaatttttccgctcgttcatcaggaattgaacatgtggcgggaaaaatcagattccattaaaaataccgaactgcggcagcaggcggccgcaagtatccgcgataagtcgtttcattgtgaaggaggcggcattttagccctgctttcgggagagcagaaacagaaatgcgtgcaatttatcatcgcgtatcagacaatcagtgattatctggacaatctgtgcgaccgcagcacctcgcttgatccggaggacttccgcatgcttcatctttccatgcgtgacgcgctgacggtcggtgccgaggtgcggccgtactatcagtacagagaggagcgggatgacggcggttatcttcatgaactggtcagaacatgccagcgggtgctcgggtcaatagaacattacggtatcattaaaccttatttgcttgaactgtgtgattattattgcgatcttcaggttcataagcatgtcgttgagcatgaacgggttccgaggcttaaagcctggtttgagcagtacaggtcgcagcttccggaaatggagtggtttgaattctcggcctgcgccggatcgacgttaggcattttctgtctcgttgcttactcattccagcctgattttaacgaacataccgctgagaaaatccgcagcagttattttccgtacatacaaggcctgcatatactgcttgattatttaattgaccaggaagaagatctgcttgaaggcgatctgaatttctgtacgtattatcagtctcatgaagaaatgatgcagagactgcagcattttattgaaaaagcggatgaacatttgcaaggcattccgcatgaaaattttcaccggctgatcaacagggggctgctcggcgtctatttatccgatgacaaagtcgccggccaaaaagaaatgggccgcctcgcgcgaaagctgatcagggcaagcggaaaaacgtcatttttcttttatatcaacggaagagcctaccgcaaatttcagaagatggcttggacgaaaagttcgtaatgggtgaactgcgcctctcgtgtacatcatgacggcgcagttttttatttatgatgtgaagaatgaaacattgtgtgcgcctgcagaatatgatactttaattttatgaaaaaattaaagtatttagcggtcatagcattactttccatttccggaggctgctccgtcacccatgcttccgccggctatcatcctgtcttgatagcgcacaggggctcttctgcgattgagccggaacataccgctttgtcttatgcacgtgcgattaaagacaaagcagattatattgagatagacttacgggagacgaaggacggccgtctgattgcaattcacgataaaacggtagaccggacaacagatggtaaagggatgacagatgatctgtctttggctcagattaagaaactgaatgcgggaaaaggagaaaagattttaacattagaagaaatcatacagaaattcggacaaactgccaattactatattgagacaagagaaagcaacggcagcctggtgatggaaaagaaactgattgacatattacaaaaacataagctgatttccggccataaagcagtcattgagtcttttagcgggaagagcttaaagaaagttcgttctatgaataaaaaagttcctcttgttcgattattaaaagataacgaggctgaggagataaatgataagcagctgcaaaccatcagaacgtatgctgatacagtcgggatcaacgccaaattggcaaatgaagcagtcgtgaagcgcattcatcacaataagatgaaagtgcacgtgttttttgataaggaagacgagcatacgctgacgcctattatgctgaaacaaaaagcagatggtgtctttacgaacaatcccgcttatacacgcagcgtgctgcaaaacagtaaataaaaagagacatgcgcattttacgctgtctctttttttaacggtttcttttttgccgcaaggtgcattgcgaatttgccgatcagcccgatgacaaaaaatgcagcaaaccaccagtaataggttttcgcgaactcaaatcctaaatgtcttgataaaatgatgacaaacatcacatagggaacacttgaaaatatgatgcgaagaatattcaaattgccgctcctcccagatgttacacttaaaagatgaacttttttccattatttcatagtaattgatttttcttgaaaagtaaatacaaaaagaatcggcccgcttatgacaggccgattctttatttgccggcagatttcttttcaatcgctataataaacggcgggtcgttttgctggttgagaaagccgtagctcagcacgcgggctttttcctgatcaagattgctgcagtattccagtaatgcacttttttccgtcttgccttcaggatgcccgtggtacacaacgagaacgatcagcccgttctccttcagcagttcaaggagctgttcgatcgcggaaatggttgagtgaccgtttgtcgtaatgcttttatcgccgcctggcagatagccgagattaaagacggcgcaagccacacgaccgtgcgcatcttcaggcagcgatgcctttatttgatcatggcttttatggtgaagcgtgacgcgcgggccgaagtcggcaccgagccgctccttcgttttagcgagtgcgtccgcttgaatatcaaaggcatggacatgtcctgtctcaccgacaaggccggccagaaaatatgtatcatgtccgttgcccatcgtcgcgtcaaccgtgatatcaccttcctgtgcggcggacttcagcaattctttactgaaagggaggatgtgcatcaaggtcatagggcggtctcctccccggtctttctgaagagctttccttgatagcttccccgtgtttccagctctttttgaatggcgcccagtacttcccacttattgacgctccacatcggcccgaccattaattcgattggcccgtctcccgtaatgcggtgaacgatcatttccgggggaatgatttcgagctgatcacatacaagacttacatattcttcttgagaaaggaactccagctttcctttttcatattgcttcaccatcggtgtgccttttaataagtgaagcaggtgaattttaatgccttgcacatccaaatcagcgacggctttggccgtctccatcatcatgtccctgttttcaagcggaagcccgttaatgatatgggaacaaacgcggatgccgtgttttctcagtttattgacaccctcaacatagcagtcaaaatcatgggcgcggttgatcaggagtgcggtccgttcatgcacggtctgcagcccgagttcaacccacaaataggtccgctcattcagttctgccaaatattccacgacatcgtccggcaggcagtccggacgggtcgcgatagacatgccgacaacgccgtcaagcttgaggacggattcaaatttttcacgcagctcctctaccggggcatgcgtattcgtgaacgcctggaaatatgcgatatatttaccgtctttccacttttcgtgcatacggtttttgatatcgtgaaattgcgtgagtaagtcatcggcccggttgccggcaaaatcgccggagcccgccgcgctgcagaatgtgcagccgccgtgtgcaaccgtgccgtcccgattcgggcagtcaaaaccgccgtcaagcgcgactttaaacactttatgcccgaaatgctcccgcagatgataatttaatgtatggtaccgtttttccgtatttgaataaggaaaagggttattctcgttcaatgttcaaaaagcctccctcacatcagatgcatcctaaaattgtagcatgaatgatggggcggaacaatgaaacaattatggaacggtcaaggcgtaatatctacctggtttttctgttgttgttttaatcgttttggagaaatatcactgaacaatgcaaaaataattcctaaaataagaattacactgcctactttgaatgtattattaaaactgtcacttattttttcattatataaatttgaaatttttttctggatagcgataacttccttcttttgagtattgaaacttttttgtaccttttctttatatggatccggggttatagaaagaatttcttcctcttttttgtttaattcagcaatactttttcttcgatcgaaacctttactgtctgaatgctttaagtgagttattatctcgttttttgcatttttatcaaaaacctgattgttttccacaattgttatggcttctttttttgcagaagctgtgtgatcatttatattcattgtaagcacagatgtaagtatggcaatgcctagcgcttgtccaactgtccgcatcatattaagaatacctgaggcaatacctactttctcaggaggaataagccgtatccctgaactcattgccggtcctatcacaagccctaaagctaagccggtcaaacataacagaataactaccgttgttacagaactgtcgtatcgtatgtatccatataaatatgttgtgattgttaaaccgagcatacctagacccgaaagccaaatgcccccgagtttatcagatagctttccagaaagtacagaggtaaacatagatgatagagctaatgtagaaacaattaaccccgcttctaattcagtttttcccattaaattcgtgaggagtaaagtaataataagggtaccgcttgttaatccaaggccctgcataaagagggtgaaagaactgaaactaaacgtacgtatcttcagcatggataagggaatcatcgggtttttaattttagattcaataaagaaaaacaaacagaataataatacagagattacaaaaagagagataattaatggtgatgaccagcctaaatcagatacttttgcaaagccaaaggttaaacagaagagagctccggataaaataagaatccccatgtaatcaatttttttactcactgtttcatcataactctcagtaataaaaaatgctgctaaaaaaagagaaatcaggcctaaaggaatatttatgaagaagatagcttgccaattaaaattttcagttaataatcctccaagtacaggtcctaaagtagctgctaatcctgagaaagccccccagattccaatgatcaatccttttttattttgaggaacgatggccaaagcaataggcattgtaactggcacaatgaaagcagcagataatccctgaatcactctaattgtgataagcatttcaattgaagtgctcaaacaggcaataactgatgtcaaaataaaaagtgctaatccaaacataaaagctttttttcttccaaaatggtctgccagctttgatgcacctactaataaaactgcaaaagctaaagtataacctgtagccacccaagctacttgagaaaggttgctcgaaaagtaatccagcatcttaggtaatgcaatatttactatagtggtgtccattaccgaaatgaatgtacctaataataatgcagataacataattaattttttgaaattcaaaactacaacctccatcagatattaatctaaattaaaattcgatatatatctaaaaacatgataaatgcaatcttaagaggtgtcaatattattcataaattgttttttcatccacttatctcgaaatcatatttttataattcaacaattttgtaacttgaaataactcaataagagcttaaatggacctgtaaactagctgagatgattaaggatttctgaagagtatgacatgaggagaatacttagcatgaggtgaagcaagtctaataaatctaggactgctcatgataatgctcagtcaggtaagtgctaattagaaatgaatattctttgaaagtttccttttgattgataatattaaaaatgtaaaatgtctggcatgaagatagtacaacgttttcctttgtggaaaaagactttatggggtgtgaaaaagtgcggttaataataaatgacagtgtttcagaattctttgacaagatatcctctattctattcttaaaacacgaggaattcttcaaagattatacaaccaaattgggtttgaatttagataatgaatattttgtattattagatgatcttaaaagaataaaagagttagatagtgagtttttaaatttttattttggcagcttttgcgactacaaagatgttaggaatgcaaatattttttgtttagccacaacattttttaaaataccacaaatttacacgaaagatttttttgaaattattgattatttgtctgcagttacagaagaagagataagaaaaaatattttagagtctctaatttatttacaaggagatcttaaaaccgaaacatctacccaacagtatttaaatgatagggaaagtttatttgagctacttaataatctaaatataaagcccgaatacaagtggatcatatttaaggtaatgaaatctcctaaaacttatgtagatcaattttgcaataaattaatgttggtgaatggttatcttaacgaggcgatttataatttaattaaattcagagatgagtggatgaatcaattaaaaaacataaatatagattttccaaaaaagataatcagtacgttaaaaggtaaggaatacttatcttgtaattatattaatatatatccaacacttttaccttgcactgcaactattacgaaaagtgaagataacatttatgttggactgggttataaagttgataaaatatttgaaaatacattagagaaagcagagattaatcatatcattgattttttgaagcttttatcggataaaagtaagttcaagatattaatcttacttagtcataaaaaaatgtatgctaatgagattgctgaacagctaaatttaaccaacgcaacgatttcacatcatatgagaattttgacattgcaaggtttagttgagagtacgagaaatcaaaataaaacatactattatcttaattcttcaaaattcgattcacttttgaacggtttgttgaaaaaatttaaagctgttccagtcttagatggggatgagtaagttttatagttggtgttagtttcgggatgataattaaagctaataaaaacagatctaaaaaatttgatgaatcccgggtgttttacacaaaaaagataatttaatggtgaacaatttaaagcgaaccgaagatcttgtgggtgatgtggaaaaattatgatgtttttaataaaagaagaattaagttatcgttctaaaatgaaggatttttataaagacttcattctgtcttgattaagttttacatttaatcgtattttatgccatctctgtcttgtgaatgaattacctgatatttcttgtgagaattaatttggaataagaaatactattgatatgacattatcaataggaggactgtttaatggcaacaagacaatcagtagatgaacatctccaaagaagcgaacaggcatatgaatttgcgaatgagcaatttatgaccgcttcaaaacaagagcattataatgataatgagtacagtgaagcgcaaatgatgcttgaaaacgcggtgaatgaattaaacaagctgtcattatctgcgaatgatcagcaaagagagcagctttaccgaatgagattgcagctgcagaccttgcaaaacaacatgattttgcagcgtaattttgattactgaccgcgccgtttcaaatggttcagcaaacctgccggaatcccggcgggtttttttgtatttttttaaaaaaagaattgacaataggcctgagtgtgtttattgtattacgtgtactacttgatgtaatacacataaaacactcgaaaaatgaatcgacatataaatgttaagcatagggaaggggaactttcatgaaaaacaaaagatccgtaaaacaagatgtgcctcttattatcgccgcttcggttttggccagcagtctgtttgtcgttcttgtcgtcatcggttttcaatggcagaacatttaaagaaagagagcagctcgtaaaagaaagaagggaagtaaatgattcaaatcgatccgagaagctcaactccgatttatgagcagatcatacagcaattgaaagagctttgtttaaaagggatcatgaagccgggggataaacttccttctgtcagggaattggcaacgatcattatcgccaatccgaacacagtcagcaaagcgtacaaggagctcgaacgcgatggtgtcattgaaacgctgaggggaagaggaacgtatatatcggagaatgcaaaaacgacattggttgaagggaagatgacgatgataaaagagcaattgaaacagctcatcatcgatgcccattacgcgggagttgagctggagaagctgcaggaatggataaaggaaatcagcgctgatgtgaaaggaggaaaggatcatgattgaattgcggaatctctcaaaaacgatagacggtaaagaagtgctcaaggatatttcgctcaccatcggaaaaggggaaattttcgggctgctcgggcggaacggatcagggaaaacaacactgctccggctcattcagcagattctgcttccggatcaagggacggttttatttaatcaggtggaaataaagcgtcatccgaaagtcaaacagaacattatttatatgcctgttgaaaatcctttttatgacaagtatacatataaacagcttgttgcgattgtaagcagaatctatccgaattttgatgtgacttacgccaatgagctgatgaacaggtacggcattccggaaacgaagaaataccgtgaattatccacaggcctgaaaaaacagcttgcgctcgtccttgcctttgcttcacgcccggctcttatccttttggatgaaccgacggacggaattgacgccgtaacgcgtcatgacgtgctgcagcttatggtggatgaagtagctgaacgggaaacgagcattctgattacctcacaccgtttagaagatattgagcgaatgtgcaaccggatcgggtttttggaaggaaatcagctgacgaatgtgatggacttggatgatatgaaggaagagtacatgaaaatccaaatggcatttgaagaggacgtcgccttgaagatcagagaacaaaatataccgattctcgaccatgccggtgtgttttatacggtgctgattcaaaagaacgatgagaagaaaaagaactttctgcaagagctgcagccgaaagtatggaacgaacttcctgtgaacttagaagaagttttcatcgcgaagtttggaggggaccggagatggtagacaggggattgctgtacagggaatgggtgcagaatcgaactgttcttgtgatggtcggcatttttttagcggcggtcaatccatttgaagtgttaaatacctatctggtttatcaaggctgtctggacacccacgaagcatattgtaagttttatgtgaattctttggatagcggaatgctgaacttaaactgggcgcccgctgtgattttggcggtttgcttattcggactggaacgtacgaaaggaacgattgatgcgcttttcagtctgccttattcccgcgctcaggtgtttcacactaaattttggctcggagcggcggtcattaccggcgctcaggtgatcggctacgggctggctgagctgctcattcttctgttaaagcctgagcgcgtatatttcttccaccattacagcgtcggagagattattgtgagtgttttggcttttacattggtcgcgagcgcaggctgcttaacggggaatacgttcgcccagctgttaacggcgtttgccgtgtcgatagcgccttacctgattattacgttgccgctgacaaatgcggaagttatcttcagggtcggcatgcatgagctgatgccatcagtcaatgcttacctaaacgattcgtttcaatatctgattccgatcatgtatgttaatacggactgggtatctgccagcaagtatatattaatcattccggcagtgatgagcattgtattttatgccatcgggtacttttgctatgtcaggcagccggtggaacggaacggccgtttttttctttggagacagcttgaccggcccattcagattgtggtgatcatcatcgccgttctcggttttggcctggcggggtactcgacgggacatacgatgacagggtatgtggccgggatgctggtcggaggagcgatcggatttttggtcagttattttgtgatttataaaaaaacgaagcatgtgtaagagaggaggaccggaatgataccgcggggattgttgtacacagaatggaaaaaaaatcagtggttgtttttatgcagcggcattcttttaatggcggcaaacccttttatggtttataacaactactcaacatatcaagaatgtttgaataacccagctcttcaagattgtgaattcgttgtcaattatacgaatgggtcgcctctttccttcagctgggttgtgagtgtcatcattgctgtcttcttattaggcttggaacggacaaagggaacgatggatgctttgttaagcatgccttacagcagaggccaaatctttcagacgaaattctggctcggcggggcagtcattgttgctcctcaggcgataggctatggagcggcgtcattgctgatatctttgttgaaaccgagccatacgtacgattttgatcatttttcaatcggaatgattgtcatcagctttatggcttacgccttgttaatggcatccggagcaataacgggacatatattcgcccagctgttaacggcgtttacagtaacggttctgccctttttactcatcggtctgccggccgcgaatttggaggtcgttttcgattttagtgtcggagatcaattttcttttatcagcagttatatcgaatcccgtctttttatatttataacccctattggatatgtgtttaacgactggatcagagaaagagatttgattttaatcattccgattgtgatgagccttgtcttttatctgatcggttacgtcagctttctgaaacatccgaatgaacggaacggcagattctttctttggagaaaattggaccggccggtgcagatcttggtgattgcgtttgccgttatgggtttcggcgttttcggatatggggtcacagacacgatgttcggctatttagccggcattatcttcggcgcggttatcgggtttttcatcagttattttacggtttacagacagtcaaagcatatgtagatccgtttgaaaatgagcagtttggaggaaggcaaggtgccgattagcggtttgctttataaagaatgtaagcagcggcagacgctgctgctgcttacagcggggttcttatctatcttaggccctttggcaattataaatgagtattttcactataaggattgtttacgtgcacttcagctgtacccggggtcagtttgtacattcagcatcgattacagcaattatcggaatttgattgggcttcatttcattccgccggttgttatggggctttttctgataagagcaggccgggctgaaaggatgtttacactgagtcttccgtattcgagaagccggatatttcatacgaagtttttcttgggagcagccgtgttagccggctcgcagtttgtttcttacggagtatccgacatattgttcctagcgcttaaacctgacgctgtccatcattttcaatcattcagcgcagggatgctggtcatcagcttgatgatttacgcattagtgacagctgccggcacgataacgggcaatttagcggcgcagctgatcacagcgttcacggtttccgtctttccgatcgtggttatgacgatttatctgttaaacgccgagttcctttttggcaggcaggctgtgccggatattgatttcccttggagcggatttctgatctatttcatgcctgccgcttacatccatacatcatggatgtattacatgaaacacgcattgttcatctccgcattaatgggattttgtttctatctattcggctatgtgaatttcctgaaaatgccgaatgaacgaagcggacattttatcctgagcaaacacattgaacgcatcattcaagtgctcgtcatgtcgctcagtatgctgggaagtgcgggggtatgcggatatgcttataacggttcgtataccggttacatattcggcatgctcatcggtgcgattatcgggtttttcatcagttattacttcatctataaaaaaacgaaacagatataagggggagtggtgtacgtgatagaggtacagcatatcgatcattcatttaaaatcggcaggaaaggcagagagagtgaggttccggtactgaaggatgtctctttgaccgttgaaaaaggggaaattgcctgtatcgtcgggcggagcggttccggaaaatcaacgcttctgaatttaatttcgggatacatagcgccgacaaagggccgtatcgtcattaacggcactgatgtgacgggtttcaatgaaaaagagtgggcgcagttccgcctcgggcatttcggctttatttttcaaagctttcagctcatcccgagtctgacaacctatgaaaatgttgaaatgccgcttgccttaaaaggtgtcaaaccgtctgaacgcaagcagaaagtcgcggatatgctgaaacgggtcggacttgaaaatcatgcgaatcattatccgaatgagctgtcaggcggccagcagcagcgtgtcagtatcgcaagagccctcattttaaatccgtcaattattttagccgatgagccgacgggaagcctcgattcagaaacggaacttgaggtgcttgcattaattcagcagctgaaccgggagcgcgggattacatttgtcatcattacgcatgacgatgaagtcgcttcgatcgcgcattcaaaattccagctgcatgacggtgtattaaaagggggcgttactgttgagatttaaggatcagattcactttatcagaagaaatatgaagaaaaaccggctgcgtgttttcatgacggtgctggcgacgacaatggcgtgcgcgtttttagtggtgctggcttccgtcggattcggcatccaaaaaacgattacagacattacgatgagccagcagattgttacggaaatcaatgtgctcggccaagagaacggaaaagccgtgaagaaatcagacttggaaaagtataaaaatgtcaagtctgtcgttgagagaacacaagtgtatgaaccgaacaaagcgtcattgggaaaccgaacaaatgaagattcagccattgtgctgacaaacatgaaagatgaagtcaaagccaatatggagcttgatcagggaagagtcgcccgtacagagaatgaaatcgtggtcggctatgattttgcgaagaacctattgacgaaaaaagaggctgacgcttacgacaaagagttaaaggatcaccaaggcgacatgtcggaggtgaaaaaaccaaaaggctatacgaaagacctgcttaataaaacgatacagctgagcatctccaaaacaaacaaagacggagacgttgaaaaaacgaaaacgtacgacttcaaagtagtcggaattacaaaaaaaccgtcccaagattggatggaggatacaaatatttttgtgagtgatcaattcaagaaagacttctcgacattcttggatctgaagaatggaaatgcggaaaaaagcatcaatgtgtatgcggacaaattcgatcatgtcgatcagcttacccatgacctcacggatgacggcttttatgtcagatctgtcacaaccgagctgaagggcgtcaacacctttttcctcgtctttaaaatcggtctgatctttgtcggctttatcgccgtcgtgatttcagccatcggtattttcaatacgatgacgatggcggtgacggaacgaacgcaggaaatcgggattatgaaagcgatcggcgcaagcccgtccatcatccgcagaatgttcctgatggaaagcgcctatatcgggatattaggttctgtcatcgggattatcatttcttacggagtgagttttgccgtcaatctggctgtgccggttattttgaaagcggtagggggaaataccggagctgaagatcttcattataccttctcctacatcccgctcagcctcgttgtgatcgcagttgtcatttgtgcgggggtcgcggtgatttccggtatgaatccggcccgcaaagcgacaaaaaccaacgttctgaccgcattaagaagagaactgtaaaggaaaaaagccggctggacatcagccggtttttcctctatctatcagaaaagggcggataccatgtttcacattttgttaatagaagatgataacactttgtttcacgagatgaaggagagattaacgggctggtcatttgcggtgcacggaataaaggatttcagccgggtcatccgggagtttactgaaattaagcctgatttggtgatcattgatgtacagctgccgaaatttgacggctttcattggtgcagaatgatacgctcccaatcaaacgtgccgattctctttttgtcctcgcgcgatcatcccgcggatatggtcatgtcgatgcagctcggggcagatgattttattcagaagccttttcactttgatgtgttaatcgcgaaaatacaggcggtgttccgccgtgtgcaccaatacggcacagaaccggcgctgatgaaaagatggtgcggggcggtcattgacacagaaaccaacacggtcagctgtaaaaacggttcggtcgaactgaccaaaaacgaaatgctgatcttaaaactgctggctgagcagaaaaataaaatcgtcagccgggaagaactcatcagaagcctatggaatgatgagcgtttcgtcagtgataatacgctgacggtgaatgtcaaccggctgcggaaaaaactcgatcaattaggcatcgggaaaatgattgaaaccaaggtggggcagggatacatcgcaaaggaagaagacggtctttatgattaaatcatttctgctcgaaagaaaaagctggatcgcgatgtttcttttgcagcaggctgtgctcctttttgcggcatatattgatgcgtctattccgtttttttcggtgctgtattttgtttacctgtcgcttcttgtgtttcttgtatttctcttgttccgctatcgtaaagagaccgcctattataaaagcttaagagagtgggacgccaatttagacatgtcttatcttaaagcgcctgacagtccgtttgagtctatcgttgaagaaagcattgaagggcagacagagcaattacgaaaaagctcacttgatcttcaggcggcgtcagagcatgaaaaggatgatctgatgtcatggattcacgaggtcaaaacaccgctgacagcgatgcatctcatgatcgagcgccttgatgaacagccgctgaaagcccctttgctgtatgaatggctgcggattcaccatctcctggaccagcagcttcatcagaaacgattgtcctttattgaaaatgatttatcattccagcgcattcagctcagaccgctcgttttcaaagaaattaaaaacctgcaatcatggtgcatacaaaaagggatcgggtttgacattcagcttgattcaccggacgttcacagtgacggaaaatggctttccttcatcatcaggcagctgttaagcaatgccgtcaaatacagtgaagcggatgacattaccgtaaaaagctatgaacaaaacggccgggtgcatgtcgatatcgaagaccgcggcatcggcatcgagcccaaagatcttccgcgcatttttgaaaaaggatttacctcgacgcgaatgaggcgagatcacgcgtcaacggggatgggcctgtatttggctcgaaaagccgcggctccgcttctcatccagatcagcgtgcgctctgagccggaaagcggcacgatttttaccttggtgtttccaaaacagaacgatgccgtcagcatgttcagcgtgtgacaaaagtgtcacatgcttttctcttttgttcgcttaatcaaacgaaaaaaacggcttctgtttttaaaataaagataaccaatgtaaaaggagaatcataacgtgatgattttagaagcaggcaatatccaaaaaagctacggaaacaagctgaataaacaagaggtgctgaaaggaattgatcttcagattcacaaaggggaattcgtcagcattatgggcccgtcaggatcagggaaaacgacccttttgaatgtgctttcctccattgataaagtgagctcgggcaccattaaactgaacgagacggagattacatccatgaaagaaaaacagcttgccgaattcagaaaacggcatctcggctttatttttcaggattataatttattggacacgctgaccgtgaaggaaaacatactcctgccgttatccattacgaaaatgtctaagaaagaggcggacctgcgatttgccgagacggcagaggagcttgggatctatgatttgagacataagtatccgagtgaaatttccggcggacaaaaacagcggacgtctgccgcaagagctgttattcacgagccgggcattatttttgctgatgagccgaccggagcgctcgattcaaaggctgccacggatttattgaataaactcagccgcctgaatcaaaaacgccgcgccaccattgtgatggtgacgcatgatccggttgccgccagctattccggacgtgtggttttcattaaagacggccgtgtgtatacgcagctgaataaaggcggtcaggacagaccggacttttttcaggatattatgaaaacgcaaagtgtattgggcggggttcaggcatgagtattcatcatttgatcttccagaacctgaaaaagaatatgaaaaactattatctttacgtttttgcgctggtgttcagcgccgccctttatttcgcgtttgtcacgatgcaatacgatccggcgcttgatgaaatgaaaagctccataaaaggagcggcggcaatccgggccgcctctgtactgcttgtggcgatcgtgtcggtatttcttttatatgccaacaccatttttattaaacggcgcggccgggaaatcggcttattccgattaatcgggatgacgaaaatgcacattttccgcatactcagcgcagaaaatttcattttgtatttcggatcgatttggatcggtattttcgccggcttttccctctcgaaattatgtatgatgatgctgtttcatacagtcggtgtgaaagcctctgtctcactgtttttttcaagcaaggcgctcgttcagacgttaattgtgttcggggcaatttacgtgctgattatgatgatgaattacttatttattaaacggcaaagcattttgtctttatttaaaaccgcgtcatcgtcagaaagcggcataagacggctttcttgggtgcagatgttgatcggcgttgtcggtattgcggccattatcgccggctatgccgtgtccgcggatttattcggaggcagttttacgagcatgaatgaactgttttcggccatggtgtttattctcggctcggtcattatcggaacctatctgttttataaaggttcggtcagctttctggcaaatctcatccggaaatcaaaaggcgggtatctgaatgtcagtgaagtgctgtctttgtcatccatcatgttccggatgaagtcaaacgccgtattgctgacgattattacgactctttcggcgctggcaatcggtttgctgtctttaagctatatctcgtactactccgcggaaaaatcggctgagcaaaatacagccgcggactttgcgtttgataaccaaaaggagactgactcttttaccgctttattgaagaaaaacggaattgaacacaaagtaaaaacaatcaagaccattcaagccggtgtcaatatgaagaacattataaacggcgacatgaaaagctttcaacaagacccgtccagcctggcgctgccgattataagcgagaaagacgcagaagggacggagctttctgacggagaagccgtgtttaccggatataatgatatgatgaaaagatttctcgacctgaaaacgtcgggttccattgatataaacggcaaaacggataaaataccgctggcgtataagggcttgaagaacgacttcctcctgtcatatacatttacaagcggagggctgccgaccgttatcgtcacgcagcaggtattcgaccggatcgagaaagatatcgacccgtccatccagggaaaatcaaatcggtttttcggcattacactcaaacgagaagaggacatccaaaaagctgatggtctgtttcaggcgcagcactattcagacggtgcgctttcacaatttgaaacggctgacacgcaaaagaaaaacatggggctgatcatgtttattgtcgggtttttaggattaacctttctgatcacctcaggctgtatcctttattttaaacaaatgggcgagtgtgaggatgagaaggctgattatacgatattgcggaagctcggcttcacaacgggagatctgctgaaaggcatccgccggaagcaggcgtatcatttcggcattccgctcgttctcgggctgttccacagctattttgccgttcagtcaggatggtttttattcggaacggaagtgtggacgccgatgatcatcgtcatggcgctgtatacgctgctgtactccatcttcggcatgctgtcggtgctgtattataaaaaggtcattcaatccgccttgtaaaacaagttgaggagcctccgcataagcggaggctttttttgtatgaatagaagaaagcgatttttaaaagaatagacatacgtcattttttcgcgcgggggagccttatgcagaagtattttcaattgaaatctgaaacaggggcctttcatcttttttccaaggaacacattttcacattgttgatcatcgggttgctgggggcgggcgtgatcgtattccggaaaaagctcaaccagagccgcatgatccgctatgtactattcattctccttgccgtgtcgcagatcagctatcatatatggctgctttgtcatcatgcctggtcgctgaaaacagctctgccgctgcagctgagcgacctttccgtctatttggcgatgctgatggtcatgacaaaaagcaaaaagctattcgccttcctctattttgccggtttgggcagcgccgtacaggcgatggcaacacctgatttaggggcgtattctttcccgcattttcggtacatcgtgtttttcgtctcccacggctgtgtttttcttacctgtctattcatggccgcttcagaaaggtacaggccgtcggcgcgcgggctgtgggtgtcggtgctgatcgtaaatctgtacggggcgtgtgtcttttttattgatcgtgtgctgaatgcaaattatctatatttaatgaaaaaaccgaagaccgcttcgcttctgaatgttttcggaccttggccgtggtatcttctatcaatggaagcggcggtgatattgagcttcttcattctgtatattccgttttggctgctgaggaaaagagcatgaagccgggctgtttttgcgaatccaatcatttgtaattttttcaacattccggcattatttttttcagattctgatgttgaaaaaagacgtccgcggcgatagaatgaatgtgctatgataacgtgatcgatacggagccgcggcttgcggtttccgttttttcatggggttttttatagagagagggggatcggtatgccgcgcgctttgaagatattaatcatcggaatgtttatcaatgtgacgggcgcatcttttttgtggccgctgaatacgatctatattcataatcatttagggaaatcgctgactgttgcggggattgttctgatgctgaattccggggccagtgtggcggggaatttatgcggcggatttttgtttgataaaatcggcggattcaaatccattatgctgggcattatgatcacattggcaagtcttctcggactcgttctgtttcaccaatggcccgtttatatttggctgctcatcattgtcggcttcggttccggtatcgtgtttccggccagttacgccatggcgggagcggtatggaaagaaggcgggcggagagcttttaatgcgatttatgtagctcagaacgcaggtgtcgccgtgggctcggcactcggcgggatggttgcggcgtactcgtttacgtacgtgtttttagccaatgctttgctgtatgtgctgtttttccttatcgtatttttcgggtttcgaaatatcaaaaccggaaatgcgagccaggtttctgttctggactacgagcctgtcagcagcagaacgaaatttacggcgcttctcatattgagcggcgggtatgttctcgggtggattgcctattcgcagtggtccacaaccgttgcgtcacatactcaaagcatcggtatgccgctttcattatacagtgtgctctggaccgtaaacggaatattaattgtcgccggacagcctctcataggagctgttctgaaaaaatggtcaggcgcgttaaaaacgcagatggtcatcggcttttgtatttttatcgtttcgttcggcgtgcttcttagcgccaagcaatttccgatgtacctcaccgcaatggtgattttaaccgtcggagaaatgcttgtctggcctgccgttcctaccattgccaatcagcttgcgcctaaggggaaagaagggttttaccaaggattcgtcaacagtgcggcgacgggcggcagaatgatcgggccgctccttggcggcgtgctggttgatcagtacggcatgagcgtgctgctgttgatcctgatggtgcttcttgttgtcagcatcgcagcgacggtgctgtacgacaaacgcctgaaaaccgttaataaacaaaacatccaagtgcgatgacgacataaaaaatcccgccgaaacagcgggatttttttgtttatacgaccggaagcacgttgacggcgtccttaacgtttaaatacgtctttaatgaagaaaagctggcatcaagctgattcattctcatggcgagggaaggcttgatcccggtgataatcagttctgtgccgattaatttaagcaggtggtgcaatttgaaaatctggtctgccgtctgttcgtttacctcggccaaacctgataagtctataattaagtaatcatctttagatgcggttaatatgtccgtcaaagttgtcacaattgaatcaaatcgttcttccgttaagtttcccactaacggcaaggcggagatgccgtttcggatcggaacaatcggtgttgacagcgtcgtgatttctgtgagggaatcctccaggagcttttcgtattctttctgctctgtaatgtctttttgaaaaccgacaaaatagagcttgtcttcaacatacagaggatcaatgttgagttcattccaaaacggggtgccgtcttttttgacatttttcagccgcaccgtgatcttttctttctggtttaagctctttcttattttcgcgacttgttgacggtcggtttctttgctttgcagaaatctgcagttcttacctaatatctcttcggaagcgtagcctgtcatatccataaatccctgatttgtatatatgatgggattgtcctcaagagaggggtctgtaatcaccacgccgatgcgtgcgtgatcaagcgcctttttgataagctccagctgctccagttttccggatacatttgagtcagccatgtaaaacccccttttggccgtaaagctgcgcgcttttttcagccgttgtttctcccctttttaaatgaatctacagtaaccgtagcataacatatgttctgattcaagcagccgaagtttgcaatttgtcattcgggcttgtcctcatatacactgaatatataaggggaaggcacatcatcgctaagtaagtgactaggtcattgtcactgggtgaaaaatgaatctaatgcatcaagcttaccgatcatgtgttcacatataatggaagaaacaagctttttactttcctgctcaatcgccggtatgtagatatcgaaaatcatcgtattcgtaagggggctggatggcctgaagtcgctttactaaataagggctttaggaaggtgatgaagatgctgcatcaggtaataattgcttgtgtaattggaggcatcatgggggttctcggtcatgtgaaaaagagaggcaggctggagaaacccagaatgacaaagcggtttatctatctcggttttttggaagatggttttatcggaatggctgcttccatcttacttgtcttatccgctgaccccgattcaggaattcaactcgtcatcttatccataatcgcaggctacggcggagaagctgttctcaggagctttgattttgtcagagaacaaaacagtgattcggccgaagcaaaaccacaccagcaaaaaaatcctccatcaaaataatatccccgctcacgacccgttccgggtacattcccattgtatacaaacctgcttgcacttatgaacagaattctataaaatacaggtaagattacggtagcgataagaacagtgaagaggagcagtaagaagcagatttcgcactcagagaattgacggccggtgcaagtcaatcaagtctgtttccgaactcgcctcagagttgcagcggcaaaaccgctgacgcataactgcgttaaaagtatcaagtgagtgcggcttaaaaccgcgctaacgagggtggtaccgcgggaaacaaaaatctctcgtcccttttagggatgagggagttttttttagttttagaataatctgaatataatcttcctcatcccgtcaatacttggactacatacgccgtattcaatcagaaggaggtttttacgttgagttttcagcacgaaaaaatagaaaagaaatggcagaattactggttggatcataaaacgttcgccgtcagtgaagagaatgacaagccgaagttttacgcgcttgacatgtttccgtatccttcaggagccggccttcatgtcggacatccggaaggctatacggcaaccgatatcctttctcgcatgagacgcatgcaagggtacaatgtgcttcatccgatgggatgggacgcgttcgggcttcctgccgagcaatacgcgcttgacacgggaaatgatccggctgagttcacaaaacaaaatatagataatttccgccgccagatccaatcactcggattttcttatgattgggatcgtgaaatcaatacgactgatccggactattacaagtggacgcagtggatcttcaccaagctgtacgaaaaagggctcgcatacgtagacgaagtgccggtcaactggtgcccggcgctcggaacggtgcttgcgaacgaagaagtcattgacggcaaaagcgagcggggcggccatccggttgaacgccgcccgatgagacaatggatgctgaaaatcaccgcttatgcggacaggcttcttgaagatttagaagaacttgactggccggaaagcattaaagacatgcaacgcaactggatcggacgctcagaaggcgcaaacgtgcatttcgcgatcgacggcactgatgacacgtttacggtgtttacgacaagaccggacacgctgttcggcgcggcttatgccgtactggctcctgagcatgagcttgtggaggccatcacgacgcctgaacaaaaagaagcggtagacgcttatgttaaagaagttcaggcgaaaagtgacctggaacggacggatcttgcgaaaacaaaaacgggcgtcttcacaggtgcatatgccgtaaaccctgcaaacggggaaaagctgccgatctggatagcggattatgtcctcgcctcttacggaacgggcgctgtaatggccgtgccggcgcatgacgaacgtgattttgaattcgccaaagtgttcagcctgcctgtcaaagaagtcgtaaaaggcggaaacacggaagaagaagcgtacacgggagacggagaacatgtcaattccggctttctgaacggactgaataaagcggaagcgattgaaaaaatgatcgcctggcttgaagaaacgaaaaacggtgagaagaaagtgacataccgtctgcgtgactggctgttcagccgccagcgctattggggcgagccgattccggtcattcattgggaagacggtacgtcaacagccgttccggcggaagagctgccgctgattctgccgaaaaccgatgagatcaaaccgagcggaacaggtgaatcaccgcttgccaacattaaagagtgggtggaagtcactgatcctgaaacgggtagaaaaggcagaagagaaacgaacacgatgccgcaatgggcgggaagctgctggtatttcctccgctttatcgacccgaaaaatccggatcagctcgcttcacctgagaaactggataaatggctgcccgttgatatttacatcggaggggcggagcatgccgtgcttcaccttctgtacgctcgtttctggcataaattcctctatgatatcggtgtcgtgccgacgaaagaaccgttccaaaagctgtataaccaagggatgattctcggggaaaacaatgaaaaaatgagtaaatcccgcggaaacgtcgtcaatccggatgaaattgtggcgtctcacggagcagatacgcttcgcctgtacgaaatgtttatggggccgcttgacgcatctatcgcctggtctgaatcaggccttgacggagcacgccgcttccttgaccgcgtatggcgtttgtttatcgaggaaaacggcgagctgacgggcaaagtgacagaaggcgcgggcgaaactcttgagcgcgtctatcatgaaacggtcatgaaagtgacagaaaacttcgaagcccttcgttttaacacgggcatttctcagctgatggtgttcattaatgaagcttacaaagcgaatgaactgccgagagaatatatcgaaggttttgtgaagctgctttctcctgttgcgccgcatttggcggaagaactgtgggaaaaactcggccacgaaggttcgattgcatacgaggcttggcctgcttatgacgaatcaaaactggtggacgatgaagtggaaatcgtcgtccagctgaacggaaaagtaaaagcgaaattaatggttccggctgatgctgataaagcagcgttagaacagctcgcacaagctgacgaaaaagtaaaagagcagcttgaaggaaaaacgatccgaaaaattattgccgtaccgggcaagcttgtcaatatcgtggcaaactgaccggacgaagcccctctcctacagagaggggcttttttatcaggcctctatcatagaaattgcaccgcgggctttggtatacttaacaccataaagatgaatgggagtgtcacacattgaaaataaatgaaatcagcacagccgcactggaagaaaaattaaaagcgggagaagagctgtatctgattgatgtcagagaagacgaagaagttgccgaaggaatgattccggaggccgttcatatccgcatgggggacatccctgagaagatggatgcgttagacaaggacaaggaatatgtatttatctgccgttccggaaaaagaagcatgaacgtttgtatgtatttacatgagcagggcttccgtacagttaatgttgaaggcggcatgctggagtgggaaggcgaaacaaagccgaagaaataacgctttgaagtgaaagaagaaaagggacgtgcgtctttttcttctttttttataaaaaaaacgggaggcgaatcaggtgaaaccgatgatccgcgcgatgaaaacaaacgatatcaaacaggtccggcaagtcgcagaacgcagctggcatcatacgtatgaagggattattcccagacacattcaggatcagtttctcgaatccgcctatcaggatgagatgatggaacgccggctcttgcattctttgttctttgtggcggaagaagaggggcgagtgctcggttttgcaaatgccaccccggttcaaaaagacggaaatgcggagctgaccgccatctatattgatccggattgccagggaagcgggataggcacggcacttcttaaagaatgcatcaggcagtccggcggggtaaaaaagctttatgtccatgcagaaaaagagaaccgcatcgccttgtccttttatcaagcgaaagggtttcaaagggtatgtgaatttgaagaagattttaaaggacacaccttacagacggtcaaactggtgctgaacatataaaaacgtccggcccgcccgggaccggatcgcgaatgatcagtgataagccggaagccggtctttgtgcgcttcaaataagtcatcgcacaaagagatgatgtcattcatggaaagctcggcgctcgtatgcggatcaagcatggccgcttgatatacggcttccttttttaatgtaacggccgcttcgatggttaaaagctgtgtgttgatgtttgttctgttgagcgccgcgagctgctccggaagttcgccggaatagcacggcataatttggtttttaacggcggcgcacggcacttcaacgaccgctttcgccggcagattcggtatcagcccggtattcagcacattgccgccgaatgtgaacggacggcccgtctccatcgcttctataattctcgaaccgtattctttcgagcgttcatgcgtcaggttttggttgttgatgatcccgtctctcatcgtttcccagtttttgatttgttccgcgcatctcctcggatattcatcaagcggaatttggagttcatctatcagctccggataccggctttttataaaatacgggtgatattcggcattatgctcagatgattccgtcacgtagcagccgaatttatccatcagctcaaaccgcaccatgtccttatgtttcgtcttttgtttttcgcgtgcccgtcttttaatttccggatataaatcaattccgtcttttttaatctccaaaagccaagccatatggttgatgccggcaatgcgttcttccgtaccttcgtgatccatgccgagtgagtcgaacagatctttggtacagacctggacgctgtggcacaggccgaccgttttgacatttgtatgtctgagcatcgctccggtcagagaggccatcggatttgtatagtttaacagccacgcatccgggcagacctcttccatgtcttttgcgatgtcaaataaaacggggatggtgcgaagggaacggaaaatgccgcctattccgacggtatcggcaatcgtctggcggagaccgtaccgcttcgggatgtcaaagtcaatgaccgtcgcgggtttatagcctccgacctgaatggcgtttatcacatagccggcgtgtgtaagcgcttgttttcggtcatcgtaggagatgatggatatactcggattgtagcggtctctcatgttttccagcatgagctgagattctttcagccgtacagcgtcaatatcataaagcgcgaattcaaatccgtttaatgcttcagtcagtaaacagtcccccagtacattttttgcgaaaatcgtgctccccgctccgataaacgtaattttcttcaacagaaattcctcccttttcttctcagcctttgaccgccccggaggacagccctgagataaaatatttttgaagtgccaaaaacaatacgaccatcggcagcatcgccataattgcggctgcggcgactaagtgaagattgttcgcgttttcgccgaagaaccccgccatggccacggtcaatgtctgcaccttttgatcttgtaaaaagaaaatcgcaaattggtaatcgttccagataaacacgcaggaaataatgcagaccgttgcggtaatcggtttcaacaaaggaaacacgattgtataaaaagtcctgatcaatcccgcgccgtccatcctggcggcttcctcaagttctttcggaatggaagagcggataaaccctgaatataagaaaacggtcagcggcatatatgcagccgtattaatgagaatggctgcggcatgcgtattgaccagccccgcatcagcgaccatcttgtataaaggaaccatggaagtcaaaggcgggataatcatgatggaaatcaaaaggccgaagacgattttgttcagctttgtatttcttctagcgagcgggtatgcggcaagcgaacccatgaaaattagcaaggcggcggaaacggctgtaataatgatcgtgttcagaaaggattgcccgagagaggcacgctcccatgcttcacgaaaattctgaaatgaaaaggcggatggcagcgaccattttgaactgtagtctccttttgcttttaatgacgtggtcagcaaaatataaaaggggacaaaatgaacgcacgagataacggcagccaacagcgtaaaaatccgcattcgggctgttttcatgacatttccgtctcctttcgcttgaaatacacgagagccgaaaagctgatgacaagaataataacggacataaacacgccttgggcggcggcatatcccgcatcctgccgtttaaaatataaatcatacataaacgtcgacatcgattgagaggaattgcccggcccgcctgcggtcagagcgaaaatgacatcaaacagcttcagcccgccgatgatattgatgaccatgttgatggtgacagccggcatcaataatggcagggtgatggtgaaaaacggctgaagacctcccgcgccatccatttttgcagcttcataataatctttcggaatgctttgcagccccgccaaatatacaatcatcgcaatgcctgcgtattgatacgtgttaatcatgacgataatccacgggtttgccgcagggcttgccaaggcgttgacaggaccgattcccagtgcgcccagtacatcattcagcgcacccccgtcatatgagaaaataaaataccaaatgtatcccataatcagcggactgataatgacgggcaggtagacgatcgttcttgtgagcgccttcatttttaagctctgattcaaaagcagcgcatataaaagtccgagcatattctgaaaaaaagtgcttccgatgccgtaaagcaaagtgtttttcacaataagccacgtgtccggatctgtaaaaagccttttatattgagtgacccccacccattgatacgtctgtgagaagccgttccagtttgtgaatgtgataaaagcgcctttgacaaacggaaaaatcatgaaaataaaaaccgtggcaagagcgggaacgtacatccaccacagtgacgcgggttttaccggcttttgatgctgaaatccttgggtttctcttgcaagatcactcattctttgtcagctccttgtgaatcagattgaagacggagccgcttatattccctgccgagtttcgccgaaacttccgcgggggttaagatatcggccgtcagctcctgcccggctgtccccatcacatcccacattccgttcggcaaataaaggcggtcaaaataaggctgcaccttaatatgctgatagcgcttatagtcatttgcgtagaaaatgtccgtttgcacattcactaatccggccggaagcgaggtcgcttcggcaattgatttcgcatgctcgggacgggccataaatgcgatgaactgtttcgcttcttcaagccgcggggaatccttgaatgccgccagcgtgtaacgttcgcctccgatccaaaccggcgcgtctcccttgtggacggccggggtcggtatgatgccgacttttaccttcggattgatttgagcgacgtcttggccgagggtgccgccctgcagcgtaaaggcgattttgttttgcgccatcagttcaatgagctgggaccgttttgccgtcacggcatctatattgagcaggctttccttttgcatctctttcagtttgtcagataaataggtgaagtgtgtccagcggaaggttccgtttaacagctgttttttgtaacggtgtgcgggatctgtgatgagaagcggtgcggcgaattgatcgtaatattgggcaaatgagcttttctcatagccggcaaaccagaagggggtgactgttccgccgcttttttctttaatctgtctcagtgccttcataaaatcatccattgtttccggcggtttgattctgtatttttccaacattgtgcggttgtaggccagtccgtcctttgcctgattcagagggaaggcgtatattctgcctttggcgtctttgagcatgctgtttaaattcggatcgagccgcttcgtccaagacatgccgctgaggtcggcggtatattctccgtagcggattttagcccagccgtgtgtgtcgaaaagatcgggcatgtcaccggctgccattctgaccctcatcatattttcgtagtcattgcctgggaaatgaacgtttacttgaatgtccggatgttctttttggaatgaatcagccaactttctgaatacggcgcgttcgctgtctgaggatattgtggaatagactgtcaatgttttctgcttttctccggcgccgctctgttctgccgagcagccgggtagtatcatgcaagtaaaagaaagaaacaaagccagtaagcgtttcatcttttcctcctttaaatatgatataaacgctgcgggacatgtcacctcctttcttgtgagccgcagctttgtctgacaatcaatgaagtggggagcgtcacggccagcgggacggttctgccgtttaaacggtcgagaagcaatttgacacccgtccggcccatctcttccgtgtatacttttaccgttgataacggcgtgctggcgtattctgcctcatcaattccgttgaagctgacaattgccgtatcgcgcgggacttgaaggccggcttcctgcaaggcttttaaagcgccgacagccatcgaatcacttgcgataaaaaaggcatcggggagacttccgcctttgatggcttcattcatcagccggaacccttcgtgcatgctgtattcgccgatcagtacatgctccggcccggctccggccatttgtaagaaagcggtcagacgcttatcctcaatcgttttattgctgtttacaccgtctatgacggtatgctcccgttcccggccgccgatataaccgagccgctggtaaccgagcgacagaagatgttcgatcgccttttgcgctgcggcataaaaatccacgctgacagaatcgtagcgggcgggatcgggggtgccgttaacaaataccgcgtgcctgaaagcggcgctgatattcgtaagcgcctcgtcttgcaggctgccgattacgatcacgccgtccagatcgtgaaacatatgctcttgaaaagacccgagatggatagaagatgtgataaaaactttttgccgaaagcattcttcctcaatgccttttcggatcgctgaaaaataaggatcctgccgttcttcttccggtgacaggcagctgacaacgccgatcaggggggctgaatcgctgcggctgcggttcttccgtttttttgccgacggctgatagcccagctcatcggcgatcctcagaactttttctcttgtttcatcagtcacggccaaagagtcatccttattcaaaattctcgatactgtcgcgctggatacagatgcctgtaaggcaatatctttgagacggaccatttcgtatctcctttttactaaatatttactaaacagaaatgacctggttattgttaaaatgatattatcatatattagtaagcgttttcaataactatttttggttacttttagtaaaaatcagtaaaaaagaaaatctgtttttctctatcatatttcaattgaaccggaataaattgatagagaaaggagagggtgatgtgctgaagatagctgtttttgatgaggagcatgaaaaggatctgcagactgaagtcaatacatttttaaaggggatttctgatgaacagctcgttgatattaaatatacggtagcggcggcctgtgatcctgaaggtgagcagctttattgtttttccgctctcattttataccgaaaataaaaaagcccggatgaaataccgggcttttttatgcattatgcttttttgacgcggggacttctcggtttttggtatttctccgcttgtttgattccttttctttcgctcgctaatgacttgtacagagacacgatcatcagaaggatcacgactgaaaacggaaccgcggcgagaatggccgtgttttgcagtgcggccagaccgccggaatataataatacagctgccacggcggactggatgacgccccagatgattttcacccggtttgacgggtccaaagagccgtaagacgtttgcattccaagcacaaatgtcgctgaatccgctgatgtaataaagaatacagcaatcagaataagcgttaatacggatgtcaccattgtcagcggatagtggctgagtgcgccgaacagcatcgtatccgttgacattcccgcgacattgaatacgcctttctgctgaagatccatcgcggatacaccgaaaatcgcaaaccataagaaagccaatatacaaggtgtcaccaacaccccgattaaaaattcccggatcgtccggccccttgatacacgggcgataaaaatgccgacaaacggcgaccaggatatccaccaggcccaatagaaaatggtccagctgttaatccattcgcgtttttggggatcattcggagacaagcgaaagctcatctgcacgatattttggatgtattggccgatagaatcggtaaatgagttcataatcagcactgtcgggcctgcaatgagcataaagatcattaaaatacccgcgagcgccatgttggtattgcttaagtatttaatccctttgccgattccgctccacgcagaaatcaaaaataacacggtcacgacagcgatcaggatcagctgaatggaaaatgttttcggaatgccgaataaataatgcagaccgccgttgatctgagtcgctccgagccctaagcttgtcgccacaccgacaacggtcgcaaacaccgcgatacagtcaattgctttgccgatcgggccgtttactttatcgcccaaaagcggtgtcagagtgctgctgatcaaaccgggcgcgtcttttctgaattgaaaataagcgatacataaagcgacgaccgcatagatggcccaagcgtgcagtccccagtggaaaaacgtgtaccggagcgcatcacgaaatgcttggggtgtttctgtttcacctgagggagagctgatggcgtaatggctgatcggttccgcagccccgtaaaataccaaaccgattcccatgcccgcgctgaaaagcatggcaaaccatgataataagccgaattccggtttttccccgggttttccgagttttattgtgccgatcggactcacaatgagaaagagacagaaaccgacaaatatagaaacgaccagcagataataccagccgaaagaatccgtaataaatttttgtgccgtatcagtgacttgctgcaggctgtcaggagaaatggccccccataaaaccgcagctgctgtgatgacaatcacaatccaaaaaacactggagatgttcttcttcaaacgttctcaccctctgactatttttttcaatacgccattttttagtatggtcgcacgattgcagatcattcctttcttcctgttccctcaatcaggtgaaacaaaacgcagaaaactgtatcatgtttttggtcaattatcaacggggacgctcaggtaaatgcgctttaaaccatttacagcgagcgtgagaaacgtcctgcattcaaaccggcgagacgccccgtgacaaaggctgaagtgatattgtagcccccggtataaccgtgaatgtcgagtatttctccgcaaaaatataagccttccatttttttagacgccatttgtttcggctcaatctcttttacggaaacacctccgcctgtgacaaacgctttgtccaaagaaagcgttccgtcagcggcaaccgtaaattgtttgcagtctttgacaaaagccctgaattgatccttcggcagttccgtaaagcttgtctgcggatcaagaccgttccgttccagaagaaaaagcagataccgttcctgcatccacggcttcagtgcgtttttgagcgcttttttcggtgcgtctttcagttccttgtgcatcttttgaaataactcttcctcgttgatgccgggaaacagatcgatgcgtaatttgacatcgggctgctttttcagttctttgacgacaaactggctgcagcggagaatggcggggcctgacaagccgaaatgggtaaacagcatgtccatcacgtgtgtgacaataggtttgccttttttattcaggacgctgacggccgcgtttctaagggacagcccctgaagtgttttttgtttaataaacggttctgacgacgtaaccggcacttccgtcggaaagagttcggtcacggtatgaccggccgcttccgcccatgcatagccgtctccggtgctgccggtatgcgggactgattttccgccgaccgcgataatgacggcgtctgcgttaatgtgttcgtcattgtttgtcgtaatgcccgctgtcctgccgttctcgtaccgcacctctttgattttttcatttgtgcggatggtgacattcagttgttttaatcggttcaaaagcgcatcgacaacgctttgggctttgtccgtcaccgggaacatgcgcccgtggtcttcttctttcagctgaatgccgagtttttcaaaaaaggcgatgatatcttcattattaaattcggaaaacgcgctgtataaaaagcggccgttgccggggatgtgtttaatgatttcttcaacggggaggcggttggtcacgttgcagcgcccgccgccggaaatcgccagcttccgtcccagcttgtttcctttatcgattaataatacgtccgccccttcttcgcctgccgcaatcgcagccattaaaccggacgggccgccgccgatcacaattacgtcataatgtttcatatttcatcaacaactttctttttcacgtataataggcggaaatgtccgcttcctgctattatagcgaaagaaggggattccttaaacgtattttgtttttaagagctttcccaaaaagtttcccgctgtaattattaccgtctaattgcccagttgtgttaaaatagaaaagttgaatcttcgtagaaaatggtgatgaggaaacatgtcaagcaaattgttaaggggcacgttcgtgctgacgctcggcacctatatatcgcggattttagggatgatttatctgatcccgttcggagcgatggtcggagcgacgggcggagctttgtttcaatacggatataatcaatatacactgtttttaaacattgccacgatgggatttcccgccgcggtttcaaaatttgtctcgaaatataactccaaaggagactatgagacgagcaggcggatgctgagagcgggaatgtcggttatgctcgtaaccgggatgatcgctttttcaattctttatatttcggcgccgttttttgcggaaacatctctcggcggcacgagtaacaacggacttacgattgaccacgtcgtttatgtcatccggatggtcagtctggcacttttggtcgtgccgattatgagccttgtgcgcggttttttccaaggtcatcagatgatggggcccacagccgtttcacaggttgtggagcagcttgcccggatcatctttttattgggcgcaacgtatttgattttaagagtgatcaacggcggccttgtcatcgcagtcggatacgcgactttcgcggcgctgatcggatcattcggagggcttgtcgtcctttatatttactggaataagcggaagggcgatcttctggcgatgaagccgaatctcgtcccgtctgcgaacttaagttataaaaaaatgttcattgagcttttcagttatgccgctccttacgtatttgtcggactggcgattcctttgtattcatatatcgatacgaatacgtttaataaagcgatgattgcggcgggccataaggatatcagccaggacatgcttgcgattgtcaccctttatgtgccgaagcttgtgatgatcccggtttctctggcgaccgctttcggtctgacgctgattccgacgattactgaatcgtttacgagcaggaattataagcttttgaatcagcagattaaccagacgatgcaaattattctgtttttggttattcccgccgttgtcgggatgtccgtgttatcgggtccggcctatacgttcttctacggctctgaaagtcttcgcccggatatcggacaggatatattgttctggtacgcgcctgtcgcgattctgttttctctgtttaccgtaaacgccgcgatcctgcaagggattaataagcagaaatttgctgtcgtgagccttttcatcggcgtcattataaaagtggtgctgaacgtgccgctgatcaagctgtttcagggagacggggccatcttggcaacggcgctcggttatatcgcttctcttctgtacggttttatcatgattaagcgccatgcgggctattcgtatacggtacttataaaacgggtcattttaatcgcagtcctgtccgtcgtgatgggagtcgcggtcaagctgactcaatggctgctcagtttctttgtaacataccaaagcggccaggtgcatgcggcgattgtcgtctttgtctgcgccgctgtcggcggtgcggtgtacatgtttgccgcgtaccgaatcggatttttacagaaaatgtttggaaaccgtctgccccgcgttttgaggagaggcaggcattccgcccattgagaaataatgaatagtccgcttatcgcgggcttttctttttaaaggagaggatcaggatgagacttgataagctgcttgccaacagcggattcggctcaagaaaagatgtgaaaaaaatcgtcaaggccggggctgtcatgattgacggagagccggcgaaagatgtgaaaacccatgtcgatccggaaaaacaggacatcacggtatacggagagccggcagactatcgtgaatttatttatgtcatgatgaataagccgcaaggagtgctgtccgctacagaagacagccgccagcaaacggtggttgatctgctgacgcctgaagaacagcgatttgaaccgtttccggcgggacgtcttgataaggatacggaaggctttttgcttctcaccaatgacgggcagctcgctcatcgcctgctttctccgaaaaagcatgtgcctaaaacatatgaggtccggttaacttcacctctggcatcggaagacatcgttcatctggaaagaggcgtcgtcattgaaggaggctataagacgaagccggcagccgttgaaatcattacagaaaacccggatgaaacggtgattcacttgaccattacagaaggcaaatatcatcaggtgaagctgatggcaaaggctgtcggaaatgaagtggcttatttgaagcggctttcgatgggggctgtttctcttgacccggatcttaaaccgggagaattccgcgagctgactgaagaggagctcgaaacgctgagaggcgctgaagtgtaatcgatatcagaaaagcccaaaacagatttgttttgggctttttatatagaggaacaaaaaacaaggcaaagacgctgctttgccttgcagcatgtcaggccgaaaagggccttatgtaattgttcgcttaagatgtaattttcactttttttcgtgttgtctcccacttgcctcggctaggactatgaacaagatcattgtatgctaacacatttaagtctcgctgaatggttctaggtgtaatgccgaattcatcaaccagttcctgtgttgtcacaaggcctttttcctggatgaacatgtaaactgatttaatccgagtcagcatacgatttgttgaaggtttcaaaaaaccactccctatcataagatcggatggacttgatataccacaactttcgactctaaaacttcgtacgaataagcaacaaaggatgacattctgttttttttctcttttaactgcctccattatacacgatatggacgacatgaatctaggaataagcgcagataattttttccaaatgggtgcagccttggtgcattactatgtccggaccgcttttaatattatggaaactgaaacttttttatacatgtccgtatgaaagcgggggagtgagaagtttgggagaattattgaatgcaaacattgtctgcgccggttatgctgacaggccgaaggtgatttccgatgtatctctgtcagtcaacgctggtgaaattgccggtttaatcggagcgaacggcgcggggaaaagtacagtgataaaggcggttctcgggctgtcccgggatattgaaggcggtattgagtggaatgattcatcttatgcttacataccggagcggccgagtttttacgatgaactgacgctttgggagcacctcgagctgaccgggtcattgcggggtatagaaggggaagagtgccgtgagcgggcagggcggctgcttgaagagttttcgctgacgtctgtaaaacatgatttgccttccggtttttcaaaagggatgcagcaaaagatgatgcttatacaggcatttttggcgaagccggatatttacatcattgatgagccttttatcggacttgatccgatctcaacgaagctgtttaccgacatgctgattgctgagaaagaaaggggcgcgggaattttgatgtgcacgcatgttctggatacggcggaaaaaatctgcgaccggttttatttgctggatcagggcgctctgcttcttcaaggcacgttagaggagcttcaggaaaaaacggggagccgttcactgctggattgcttttattcagcggttcggagcagtcagcgatgaccgggcgggctttgttttttcaaaggctgtttcattattggcggtatcaatggaaggtgtttcagacggtcattgattggacggtcgcgctgtacatcgttcttcccgctgccgcatttgccgtttatcaatatgctgaatggctgaacggcagggggcttcttaatggagcggcaggagtattaggatggggctggctgtatgtattcagtgccttgctgttgtgcacgggttttattcatacctttttgctggaagcggatcacgtgtttttggtgcatgcaaaacatctgatgcaaaagctgaaacggtacgcgcttttgtattcgatgttcctttcccttatcaaatggggtgcgcttgccgtattgttatttcccttatggcgccagtacggtgactgtaccttaccggcatattcaggtatgttttgctgtctgttcggcttccataccgcgatattagcggtgcaccggcacagaaaaaacagcaggcggacattcgggaatcaggcggcgggctggctgaaagtgatggttctgacggcgggtgcgttttttatgatcacctttgccgccgaatggtattggctttggccggcgggatgtatattgttcatctgttccgcttttttgacttggaaagggacggagacattatcagcctttgaggaagaagtgcttgaggagaacaggcggaagctttcactcgccgcctcagttttgatgctcagccatgatgtgcagctcccgaatggtaaaaataaagggcggagcaagccgtttttatatcccggctcaaagcacatctttacaaaacggtcggcgtatacggcgtggaaagaattgttttttaaagtgctgatccgaaacggcgggtatctccggcagctttaccttttaaccgcggcttttacggctcttattctcgttcttccgctcttagtgaagccggcagtccttattttatttgcgatcgtcagccgctatgccgcgtcacttttatttgaccggatcacggataaaccggttttaagcggtatcaagagagacagtgatgactatttccgggcgcgaaacagtgcattaaccgtcattcaaatcatctgttccgcctggtgtctcattgccgcgattctttccgttctttatatgtaaaaatccctttccgaaaaggaaagggatttttcttaatgtccgttcaaaataaaaagctgaataaaaaacagcacggcgaagatgaggactagaggatggatttcgcgccattttttcttagctgctttaacaagcggatatgaaatgaagccgagtgcgattccggttgaaatactggacgttaaaggcatcgccaaaatgacgagaaaggccgggaacgcttcgtcaagctcattccagcggatattcgacacagcacccatcatcaggctgccgacaataatcagagccggtgacgtaatcgcggacacttccgataagacgctgacaagcgggctgaaaaacatggaaacggcaaacataacggcaatcgtcagcgccgtcagacctgttcttccgccggcggccacacctgctgaagattcaacgaacgcggtcgtcgggctggtgccgaagatgcttcccaccgtcgtagccgttgaatcagccaacagcgctcttctggcattcggcagctgattgtttttgatcaatcccgcttgttcagcgacaccgatcatggtgccggtcgtgtcaaaaatcgtaacgagaagaaaagaaaacacaacggcgtacagaccgtgatgcacgacatccccgagggcaccgaacggatttgtgattaaaagcccctccggcaggcgcggaaatgaaatgaaccctttcgcaaaatggatctgtccggtcaaaaaggcaatgacggcggtcagcgccattccgatgaacagagcgccgtttacattcagcaccatcagcacgatactgatgataagtccgataagcgttaaaatgacggcgggcgaatgaagatcgccgagtgcgaccagattggatttatcagccgtgatgattccggattggcgtaagccgataaaagcgataaataagccgatgccggtcgtaattccgtattttaaattgtccggaatcgcttctataagttgttttcttaaaggcgttaacgataaaataataaagatgactcccgcgataaaaacggcgctgaaagccgtctgatacgtaatgccgctgcctgtgccgacaacgtgaaaggcgagatacgcgtttaagcccatgccgggggcaatggcgatcggaaaattcgcagcgagagccatccataaagttccgacaatggaagcgataatcgtcgcggtgaacacctggtcaaacggaattcccgcattggaaaggatcaccggattgacgacaatgatatacaccattgtgaaaaaggtggtcaatcccgcggtaatttctctttttattgtcgtttgatgcttgtcgagatgaaacataagtacctccaatgacgaacattttttcaaaacatcatctatattattcgttttatcgacattttgcaagtctttatcaagaaaggggatttgtgatgaactgggaagttgaagtcatcagaaacaaagaagatctgatccgtgacacgcagaagtttttgcagatcaacagcgtaatggacgaatcaacagccggtcccggccggccgtttggagaaggcgtcaatgccagcctggcgtcactgctggaattcggtaaaaaagaaggcttcaccgtaaagaatcttgacggctatgcgggccatattgaatggggaacgggtgacgaaatcgtcggtgttttgtgccacgtcgatgtcgttccgcccggagacggctggacgagcgatccgttttcagccgatatcagggacggccggatatatgccagaggcgccattgatgataaagggccgacaatggcggcgttttatgcgctgaaaatcgtcaaagacatgcagcttcctttatccaaacgcgtgagaatcatcatcggaacggatgaagaaagtgattggagatgcgtggatcactacttcaaacacgaaaaaatgcctgacatcggctttgctcctgacgcagattttccgatcattaacgcggaaaaaggaattatagatgcgtcactgcgcattgtaaaaaacgcttctgacaaagacgcaaaaaacgtgcttctgtcattccgttcaggactgcgcttgaacatggtgccggatgcggctgaagcggttattgaagggaacggtattgatgccgtgcacgcatatttcagcaaatggcttgagcagtcaaaaacacaaggtgaagcagtttcggaaaatggaaaactgacgcttcgggtatacgggaaatcatgccacgcgatggaaccggataatggtatcaatgccggcttaaagcttgctgaatgccttaacggaacagagctggatggagccggaaagcactttgtcaaaaccgtcagtgactattttttaaatgatacacgaggcaaaaagctgaaaattgattgcagggatgacatcagcggagagcttacattgaatgtcggcacctttacatacagaaagggtgaggatggagaactcggcatcaacatccgttatcccgtcacttcagacagcaaagtcatccgtgatgcttttacgtctgctgaagaattccggcttgaagaatttaaagacagcaaaccgcaccacgtttctgccgatcatccgctcgtaaagacgcttcaaaaggtttacgaaggacagacgggaaagaaagcggatctgatttcaatcggcggaggaacgtatgcgagatccctttcggcgggcgtcgcgttcggtccgctgttccccggccggcctgacagcgcgcatcaaaaggatgagtacattgaaatcgatgaccttctcaggtcaacggctttatatgccgaagccatttatgaacttgccaagtgataataaaaagggacgccgaaagcggcatccctttttatcattcaaatgaccataaatccgtggataaataacgttctcccgtatcggccgtcatacagatgacgatctgttcgggagggaggcgtttggcggtttcaatggcggcgaagcaggcggcgcctgaagacgggccgacgagtatgccttcttcccgggccagacgacgtgttgtcgtatacgcatcttcatcagatattttcatgatttcatcgtaaacgtcctgattcagtatgccgggaataaatccggggcttgtcccgacaagcttatgagcgccgggttttccgccagacaggacgggagatcccgcaggctcggcgacatgaacaatcatatccgggaaaagctctttcagcgtttctccggttccggtaatggtcccgcccgttcccgccgttgccacaaaagcaccgagcggtctgttgagctgctgaacggcctgatagatttcaatggcggtcgtttttcggtgggcatctggatttgcgccgttatcgaattgcatcgggataaaacttcccggaatctgttcggcgagttctttcgcttttttgatgctgccgggcattctttccgcccccggtgttaacacaacctccgcgccgtacgctttcaggaggttgatgcgttctttcgtcatcgtgtcaggcatgacgaggattgccttgtagccgcgcgccgccgcgttcatcgccaggccgatgcctgtgttgccgcttgtcggttcgatgatgacagagccgggttttaaatgcccgctgttttccgcttcaatgatcatattgtaagccgctctgtctttgacactgccgctcgggttaaacgattctaattttaaatagacctgtgctgcatgttctggctgaaggcgattgagctttacgatcggtgtgccgccgatcagctccgccgtgctgtttacgattttcaaggccggctcattcctttctgtataaaacgttcggtacataatatcctatcataatgagcggacagggttctcctctccgcttatccgttttataataacaccataaccaaagagggggagatcctcgtatgaaagcttcattgccgcattattttatcggcattccgattccggctgacattgctgaaccgatttgggaagcagccaaaaaggagccggcgttatcattcaaaaaatgggtgcacccgcatgactatcatattacgctcatttttctcggagccgcggatgaagaacggcttgcgaaattatcgtctctgctcgcagatgctgcgtcggcagcgcagccgtttaccgtacagtttcagcatctggatattttcggcgaccgcagacagccgagagtgcttcaccttgagcccgaacggaatgaactgctctttgatttgcgggaaaaaacaaaacaggctgttttgaaagccggttttcaagtggaaaaacggccgtatcaccctcatatgacgatggcgcggaagtgggcgggagaccggccgttttctgacgatgtgccgtttgaaagcggcagggtgcaaagtgccgtcagcaggttttccctgtttcagacccatcttgaccggtcgcctaaatacgaagaaatcgcacagtttcaattgacataaacaaatattcggagtggagaaatcacatggcacagatcatcaaaattcacgactgcatatccagatatgaacttgatccataccattatatgaaccagtttatccggctgaagaaagaacgctgggaggcgcttcttgaagcgtttgaccggataacggaagaaacggaaacggctgccggcggggaaaccgatcaagcgccggccaggaaaaaattttccttaaaaaagagaaaagaagaaaatacggccgatataaatgaaaagaggcaccaatggtttgatgaaccggagggagaagaggcgctgttcgggaatcttccgtctcaaaagtctgagctcgcgccttttttcaaagatcagctgtatgactttcaattaaaatgggcgagctccacgctttctcaaaagtctgagctttcgcaggcggtcaaaagggacaggatgttaaaaatgctggctcaaaaactgcccgattcctattttgtgatgtatcatccggttctgcaaattcagcaggcgtccgtcgaactgagcattatcatcatctcgccgctggagattttctgcgccgcttttatggaagcggaagaggacagtgtatatatcggatcaaaacaccgtttttgggaagaaagaggctccggcagcacgcgccaagtattgaatccgtctctcagcctgcaccggacgggctcggtcgtttcgcaaatcgtaaaagaaaagcaggccgacattcccgtgcggaagcttttgctcagcagaacgtcttatattgattacccggagccgccgtacgggctggaaatagctgataaacggactgcggcagggtggctggaaaagcagcagaaaaatacggcgccgatcaagcaccaccagctgaaggcggcgaaggctcttttgtcttacggcttgagcgattcaagccggagacaggaatggcttgattaaagcggacgtttgccggctgtctcttcatctatgaagcaggtgaaaacaaacgatgagtcaatggttttttattattaatccggtctcaggaggcgggcggggccggcgtgtctggaaatcagttcaaaaagagctgaccaggcgcggggtcagccaccgctcttttttgaccgggcatcccggacatgcggaggtgctggcaagacagatttcaatgatgcaggatcataagcttaagcggctgttcgtcatcggcggtgacgggacgatgcatgaagtcattaacggactgaaaggaacggatcagattgagctgacctttgtgcccgccggttcgtacaatgacttttccaaagggctcggtattaagaagtcggcgctcctccaagaaatcaaaagtctgcaccgcccgctcacacggaaattttttgcgggaaacatcaacttttttcatgacaaagcgcaatcactctattttattaaccacctgtctgtcggcttcgatgcctcagttttgaaggcagccgcgaattttccgttttcgcgcgttcttcggtttttgcgtctcggctttgtgatttacccgctcgcgcatttacatacggcctcggggtttcagccgttcagatttgtttgcacggcagacggccagagacgtgaattccgcaatgtctggtttgttattgcggctaatcacccttattacggaggcggcatgaaagcggcgccttcagcaaatccccgtcaaaactattttgatattgtcattgcagaaaacctgtcctttttttcgctgtatcgttttttatgggcgatgagcttcggccggcatatcaaaatggacggagtgacgatgataaaggggaaggaattcgtttttgaaacagatgggaaaattccgtttcacgctgacggcgagctgatcggaacgacgccgtttcggcttatgccgggcggtgcgccattgaaaataaaaacataataaacaaatgaaacccgtcaattgtttcacggcaacagagcggttcgcggcataaatcttcagaattcacaggtgttcttgctagttttgcttgacgaagtttgtgctgtagcgctaaaatttataggacggctattgattagcatatgagactctcaatagctgtcttttttattctcatgaaattgtttatgacaggccgctccgccaatagagaaaggctggaggcctattctaaaatattttaagaaatgatgggttgaacattgatatgaactggttgggacaattactaggtagcgattgggagatcttccccgccggaggagctacaggagatgcatattatgcgaaacataacggccaacagctttttttaaaacgtaatagctcgccctttttagccgtgttatccgccgaaggcattgttccgaagctggtttggacaaaacggatggaaaacggagacgtcattacggctcagcattggatggcgggcagggagctgaaggcaaaggatatgagcggacgcccggtggctgagctgctccgcaaaatccacacatcaaaagctttgctcgacatgctgaaaagattgggaaaagaaccgcttgatccgggcgcccttttgtcgcagctgaagcaggccgtctttgccgtgcggcaattttcgccgcttattcaggaaggccttgcttatttggaagctcatgtggatcaggtgcaattcggtgaaaaagtcgtttgccattgtgatgtgaatcataataactggcttctgtctgaagacaaccagctgtatttaatagattgggacggcgccatgatagccgatccggccatggatctcggccctttattgtatcattacgtcgaagagccagcgtgggacagctggcttgggatgtacggcatgaagctcacggaagggcttcggctgcggatggcgtggtacatgttatcggagaccatcaccttcatcgcctggcacaaatcaaaaggaaacgacaaagcgtatcatgatgccatggaagagcttcatgccctgatgaagcggattgtcaagtagtcaggagtacgaatccatctgctccacccattgggacaaatggttttggtgctcctgaatatgcgtgtcgatggaatcggccgtgatgccggactggctgtagcggtagacatcctcgagcacgttttttatatttgaatcaagcccggtgttggccatcagtgatttgatgacgcgctccagctgttcatactcggcaaccgtgccgcagcaatccaattgatggtcggccaatatgtcctttaataaccggacctgatgttcgcttgttaagcccatgattcatatacacatcctttctgtgtcatacattgtgcaaagcggtgcggttttatgcatcacatgagtgttccggaccggggagcctctttttttatgcggccggcgcctttaaaaggcgcttgcggctctttatgtttcatggtatgttgttactcgaaattatagatagaggtgtcaatcatatgagaatgcgccataaaccttgggcgaatgattttctggcagaaaacgctgacatcgccatcagtgatccggcccagtataaagggcggtggaatacggtctttggcaatgacaacccgatccatattgaagtcggtacgggaaaagggcagttcatttcaggaatggccaagcagaatccggatatcaactatatcggaattgagctgtttaaaagcgtcatcgtcactgccgtccaaaaagtaaaggacagcggggctcataatgtccgtttgttaaatatagacgcggaaacactgaatgacgtatttgaacggggagaaatcaagcgcgtttatttaaacttttctgacccgtggccgaaaaaccgtcacgaaaagcgccgtttaacatttaaaacgttcttgaaaaaatacgaagaagtgatgggcgaaacaggtgagattcatttcaaaaccgataaccgcggtttattcgaatactctctgaaaagcttttccgaatacggcctgcttctgacagaagtcagcctagatctgcacaacagcgatccgaagggcaatattatgacagaatacgaagaaaaattctccgcactcggccagccgatttaccgggccgaagttgaatggagaacaaaagacagactctgatgcgggagtctgtttttttatgccgccatttgctaccattatatcaggagggatcaagatggagacattgaatattgggaatatttcattaacatggctggacggcggtgtaacacatatggacggcggagcgatgttcggcgttgtcccgaagcctttatggtcgagaaaataccccgtaaatgacaaaaaccagattgaattaagaacagacccgattctgatcagaacaaacggcctgaatatattggttgacgcgggtatcggcagagggaaattttctgataaacaaaaaaggaattacggtgtaacacaggaatccaatttaaaacactctcttcgtgaactcgggctttcctgtgaggacattcatattgcggcgatgacccatcttcattttgaccatgcatgcggcttgacggaatacagcggagaggagcttgtctctgttttcccgaatgcccgcattatcacttctgcaacagagtggcgcgaaatgagaaaccctaatatcagatcgaaaaatacatattggagagaaaattgggaggcggtacaagatcaggtcgaaacctttgagaacgagtatcagctgacagaaggcattacgatgcaccacaccggaggccacagcgacggccacagtgtcatcgtcttagaagacggcggggagacggctgtgcattttgccgacctgatgccgacgaatgcgcataaaaatccgttatgggtgctggcctatgatgattatccgatgacctccattccgcaaaagcagaaatggcagacgttcgcggcagaaaaaggcgcctggctgattttctatcacgacgcgatttacagagcggtaaaatggggagaagacggcgaagtggctgcatctgtcaaacgggagagaaaataagcggatcgatgatttacctgtatgaatttcgggaataaaagcaaacctaagacaaattgctttgaaaggaagagacaggtgaatcaatttcaagtgacgaaagatggagaaatcaaaacaactctgcgcggattagaagtgctttctacgccttttttaaataaaggggtggcctttacacaggaggaaagaaaggaactcgggctcgagggatttctgccgccgaaagtattgacaatcgaagagcaggcgaggcgggcctacgaacaattcagttcgcagcctgatgagctgagcaaaaatgtgtacttgaccgctctccatgatcggaatgaaacattattttacaggctgttaaatgatcatttaggcgaaatgctgccgatcgtatatacgccgaccgtcggcaccgcgatccagcgttacagccacgagtacagaaaaccccgcggtctgtatttgtcaatagatgaccctgaaggaatgcgcgccgcatttcagcagttcggaaaaaatgaaaacattgacttgatcgttgcgacagatgcggagggcattctgggaatcggtgactggggcgtcggcggcatcgccatttctgtcggaaaactcgcggtgtatacggcggccgccggaattgatccgtcacgagtgcttgcggtcgttttggacgcggggacaaatcaagaaagcctcttaaatgacccgctgtatgtcggaaaccaacattcaagagtgcgcggcgagaaatatgaccgctttattgatgagtatgtctcgcttgcccgggaaacattcccgaatgcgctgcttcattgggaggatttcggcacggctaacgcccgcggcatattaaaacggtataaagataaagtctgtacgtttaacgatgacattcaaggaacaggcgcggtgtcgcttgcagctgttttagcgtgtgcgaaagcatcaaaagtgcctttaaaagagcataaagtcgtcgtcttcggcgcgggaacggccggtatcggaattgctgagcagctgcgcgaagctatggtgcataacggattaagcgaagaagaatcatacagccgcttttggtgtatcgacagaaacggattgttgacggatgatatgaaggacttgcgtgattttcaggttccgtacgcccgccctgctgatgaagtgaaagagtacggccgcagcggtgaaggcggatcaattgatctggcggagacggtgcgacaggccaagccgacgatcctgatcggcacatctaccgtttcaggcgcatttacggaagaaatcgtcaaagaaatggcctcacatgtcaaacggccggctattttgcctatgtcaaacccgacgacattatcagaagcaaaacctgaagatttaattaaatggacggaaggccgcgcgcttgtcacaacgggaagtccgttcccgcctgttgcgtataacggcgttacctaccatatcggacaggcgaacaacgcgctcgtattcccgggactcgggctcggaacgattgtgacaaaagcaaggctcattacggacaatatgttcgttgcctgcgcgaatgccatcgccggtatggtggacgtcggcaagccgggcgcgccgatgcttccgaaagtggaggatctcaggacggtatcggcaaccgtggcggtagctgtagctaaagctgcgattcaggacggtgtagcggaaacggaacccgaggatctgatccaagcggttcaggacgcgatgtggaaccccgtatataaacgaattcggccgatgtaaccgaataaagcccaaaacgctgatggttttgggctttattttttgcttgtccgaattatgaggcgacagaatcaatgacatcgacaatctggcctgtttttgcattgaccataacttcatattgctccagttcgccgaatgccgaacgtgtcacgccggttttgtatacctggatggtttctccgtttacctggtagggctccggctctgtgtaaatccatgatccgtctatcggcccgcgctgtttaaaagccgctttcacgatacggagcgctttttctgaagagatataaggtttcatcgcatactttttcactgcgatggcagcgcataatccgactcctgcacctaagagaaaatgacgtaatttcaatatgaagcacctccaattatgtcgtagtttttattatacagaagatgccagacggtgttaagtaaagcggcggttttacagcccattcaatctgagcgcttggaaaacggttgtttttctaataaaataaaagcattacatagaaatgaggggaaaatatgaatgaggaaacgaaaacgcttttccggacgctgacgcagcttcccggcgcaccgggaaatgaacatcaggtccgctcttttatgaaacgggagcttgcgaaatatgcggatgacatcgtgcaggacagactcggaagtgttttcggagtaaggcgcggcgctgaagatgcgccgaccgttatggtagccgggcatatggatgaagtcgggtttatggtgacacagattacggataacggcatgctgagatttcagacgctcggcggctggtggagccaggtgctgcttgcccagcgtgtcgaggtgcagacggataacggaccgattatcggcgtcatctcaagcatcccgccccacattttaacggatgcccagcgcgcaaagccgatggagatcaaaaatatgatgattgatatcggtgccgatgacagagaggacgcggtcaaaatggggatcagaccgggacagcaggtcgtgccggtctgcccgttcaccccgatggccaacgagaagaaaatattgtccaaagcgtgggataaccgctacggctgcgggttaagcattgaactattaaaagagctgcacggaaaagacctgccgaacaatctgtacgccggggccaccgttcaggaggaagtcggcttgagaggggcgcagacagcggccaacatgattcagcctgatctcttcttcgcgcttgatgccagcccggcaaatgatatgagcggcgataaggagctgttcggccgtctcggcgagggggtgctgctccgcattctcgacagaacgacggtcatgcaccgcgggatgagagagttcgtccttgatatggcggaaacgcacaatatcccttatcaatatttcgcttcaggcggaggaacggatgccggacgcgtccacatatcaaacagcggggttccgtctgccgtcatcggcatttgttcaagatacattcatacaaatgccgctatcatccatgtcgatgattatgccgcggcgaaagaaatgctcattaagctggtcatggcgagtgacaaacagacggtcgaaacgatcagagaaaatgtgtaaaaaaaataagcagtcaataagtccctttgaatacttattgactgctgtttttacattctgttttaagccgcatgatcgagacagttctttgttgtgaatataagtgtaaagcgtattgtaaatagaattaggtaacacatattatttttcaatattattatcaaaatggttccgatccagataaacaaccttcgaacctttattgcaatgataaacgtttttaaatcaaaaacatgctgcaagcattgagaggagcagcgatttcacaaagtcgagtcatttgcatttttatttgttctgcaagaaggtatgattatgacaaaaaagacaaatataaactttcctcttgaactgattaatactgaagtggtgagtgtaggtaagcaggaccgcataaaagcggcctgcttattctgtttcaaataaataagagagtgctttcatcgcttgattgacggtttcgaccgtgatattcgcttttccggaaagctctttcagcggatgatgaagttctttcggacggatgagaatgagcggctttccttttgcgatggcataagaagcatccatcgcggtattccactgtttatatttctcgccaaacagggcgatcacaaaatcggctttttccatcagcacctctgtacggaaattgttgatatcagaagctctggcgtcttttaaaacagaatcgggctgcacgcccataatctcttctccgatattgtctgagcgttcatggttttccatcggaccgacaaacgtaatcggcaggttcagcgcttttgctttttgtttgatttcatcccgccaatcactgtggatttcacccgctaaatacacgacaaactgcatcttttgcccctccttatgtacatattcagattttcgtacggctacaagcaaaatggtaaacgaaacttgcttgataatgcaaatgaaatatgataatgatattgcatatagttggtcttgccgtaaacagtctggtatgatccaattggacaaacatcagcatataaaaaactcataatccagatggaggaatgacaatgaaaaagattgaaagcacggaagaattgcaaaaagcggtacaagacgattgggcggtatttatgttttcagcggattggtgcccggactgccgctttgtggagccgtttctccctgagctggaagcggactttcctgaattcacttattactacgtagaccgcgatcaatttattgatacatgcgcggaatgggaaatttacggcattccgagctttgttgtgtttaacggaggaaaagaagtgaaccgcttcgtcagcaaagaccgtaaaacaaaagaagaaattgagcaatttttaaccgattcccttgctaaagcataaaggaggccacgggctttgaaaatgacgtcaaggaagctggcggatttattaaaacagcgcctgcagcacgagaaccgatccttcttttttgacagagaaaaagacaccctccgtgttgaggatcaaacgaccaaaaaaggcatcacattggagctcccgccgatcattgcgaagtgggagacgaaaaaagaagaagcgatcgacgaaatcgtctactatgtgtcagaagcgatggaggcgatggaaggaagcggacaggagatgtccggaaaggaagccggaatctatccggtcatccgctccacgtcatttcccgatcaaacgagcgacggcattccgctcgtgtatgatgaccatacggccgaaacgagaatctactacgcgcttgacctcggcaagacgtaccgcctaattgacagccgtatgctcgagaaagaaaactggacaaaagaacggatcagggagacggcgtcattcaatctccgctctcttccttcggtcgtgaaacaggatacggttgcggataattatttttattttttcagggcgaatgacggctatgacgccagccggattctcaatgattcgattcttcatgaatataagcaggccgctgaaggcgaattggcgatttccgtcccgcatcaggatgtattaatacttgctgacattcgaaatgaatcgggttatgatattttagggcaaatgtccatgagcttctttgcaagcggcacggtgccgattacggccctttcatttctgtataatgaaggcagactggaacctgtgtttatcatggcgaaaagccggccgaaaaaggattagaaaggatttttcttatgaacgctttttacaataaagaaggtgtgggagatacgcttctgatctctcttaaagatgcagcacgcgaagaaatcggctatgaaagagaaggcgatgtcgtcagaatctttaacaaagaaacaaaagaaacgacgggctttaacatttttaacgtgtcttcttacttacagattgaagacaacggccccgtcgctttgtctgagactttcgtacaggatgtgaatgaaatactgaacagaaacggcgtttcagaaacgctgacggttgacctttctccgaaatttgttgtcggtcacgttgaatcgaaagaaaaacatccgaatgcggataaactgaatatctgccaagtgaatgtcggagaggaaacccttcaaatcgtttgcggcgcgccgaacgtggacaaagggcaaaaagtcgtcgtcgctaaagtcggtgcggtaatgccgagcggacttgtgattaaagacgctgaattaagaggcgttccgtcaagcggcatgatctgctccgcgaaagaactcgctttgccggatgcgccggcggaaaaagggattcttgttcttgaagacagccgcgaggccggcgaagcatttcaattctaactcccataaataagcgcacagaatcgaatgatgtgagagaaagccgttaagcaggcctgcttaacggctttcttcagttgggagcttaatcttttctgagccgcccggcaatggtatactaaatatcgtcccagactactaaaaagggagttagagagtgattaaacatgagttggctgaataaattttttgacttatttttaggtgaaaaagaagaagagcatgaacgtgaaccgaacacgcatgcccaaatccagaaacagcaaataccggatcagccagaaggcaaattaacgcgcatggaagattctaaaatatattacgaatatccgaaagggaatttccgcttcccggtcgttccggacggctataagcgaacggagcaaaaccaaagacagcgggaaaggcacgaacgccgccagccgtcccggggttatgccgccgggaaggagcaaacggagcggaaacagcatacacataaagagcctgatacggtgaaaaagccctttaaaccgtcatccattccttcaccggtttacggctttcaatctcagcacagcatcaaaaaagcgcctatttccgaaaagcggcgtgaagagaacgtaacattgctgtcagaggagcaatttgttccgccaaaatccggtcaggaaacggaaaaagagcccgtcttcacaacatccggtataacaaaacagacgaatgaccggccagaaccgtttgcgaaacaagaaacggaagaaattccggccgttaaaaaagaggagcttcacacggaggctgagaatgcaaaagagcaagtgtttgcagcaccagaaccgcagcaggctgaagagctggagcacaccgaaagcgcggagtctgccggctttacagaagaacaagagcatgaacaaacccgcccgcagcctataagagagcctgagtctgaagcatcccgaacggctgaaaacacagaggaacaagcggcgccggagggggaacatcaggagcctgagccggaaaaagcaccgccttttgaaaccgcagaagaaccggtgtatacatacacagaacccggatacgaggaaattcagccgcagtctgaagacaagcccgaatcagctgaacccgacgcgaaacaggaagcagactctcagcctgagtacaatgaagcagagcggcattcagaccccgagcctgaacctgtaagcattgagacgaccgatgccccatcccggcctgccgaagaaaaaacggagcatcacggacagcctcagactgtgagaaaagcggagcagccgaaagagcgcaatgttccgtttaacgtcatgatgcttaaaagcgataaacacaagcagacgaagacgccagagggcggagcgagctatgtctttccgaatctgtcgcttctggacgtaccgccggcgcaaagacatgacgaccaatcgtggattgaagaacagcgcgagcttttaaacgttacactgaaaaactttaatgtgcgcgcccaagtcgttcatgtcacacaaggcccgtccgtcacacgttttgaagtgcatcctgagcccggagtgaaagtaaacaaaattacaaacttagcagatgatattaaactgagcctgtctgccaaggatattcggattgaggcgccgatccccggtaaaaacacgatcggcattgaagttccgaaccgcgtaagcaaagtcgtcgatttaaggcagatgatcagaagcgccgctttcaggacgaatccgtctccgcttacagccgcgctcggtgtcgatatttccggaaacccggtcgtcattgatttgaaaaagatgccgcacgggttgatagcgggtgcgacaggatcgggaaaaagcgtctgcatcaataccattttggtcagtctgctttataaggcggatccgagtgatgtcaaaatgcttctgattgatccgaaaatggtcgagcttgcgccttataaccaaattccgcatttggtcagccccgtcatcacggacgccaaagccgcgaccgccgcgttaaaatgggttgtggaagagatggaacggcggtatgaactgtttgcccattcgggtgtgagagatatcggacgctttaatgaattaacggccgatcataagacaggcgaaaagctcccttacctcgtagtggtcattgatgagcttgccgatttaatgatggtcgcgccgaacgatgtggaagaaagcatcgccagaatcgcgcagaaagcgagagcctgcggcattcatctgcttgtcgcgacacagcgtccgtctgtcgatgtcattaccggaatgatcaaggcgaacataccgacgaggattgcattctccgtctcaagccaggtagattccagaacgatcatcgacatggcgggagcggaaaagctgctcggaaaaggcgacatgctgtactgggaaaacggtaccggaaaaccggtgcgcctgcagggcaactttgtatccgacagagagattgaccgcgtcgtctctcatgtcagaaagcagctgccgccttcttatttgtttgaacaggaagaactgatcaggcagggaaccgcccttaaggaagaagacgaactgtttcctgaggcgtgccaattcgtcgtggagcaaaacagcgccagcacctcaagccttcaaagaaggttcagaatcggttataaccgcgccgcgaggctgattgacatgatggaagccgaaggcatgatctcagaagcgaagggcagcaaaccgcgtgaagtgctgattacggccgctgacatttctcaagaataagaatatcgttcatttttctcacaaacatggtatgatagtggatggaccatcaaaactgcatcactgtcacgcgctgaaatatcatgcggcaggtttaatcaaaaagaaagttacagatactgacgataacgtaaaaataaatggaagcgccgctgtgcgggcttttcgcccgctgcggtcgcaaaatgaaatgagcgtcatatactggggaacagatagacgtttgttggaggtacgattatgactgtttatcattttgttggaataaaagggacaggtatgagcccgcttgctcaaatcctgcatgatacggggtatcaggtgcagggatcggatatcgagaagcagattttcactcaggctgcccttgaaaaaagaaatatcccgatctatccgttcagcgccgataacatcaaacccggcttaacggtaatcgccggaaacgcattccctgattctcatccggaaattgcaaaggcgctcgatgaagggattcctgtcatcagatatcataaatttttagctgaatatatgaaaaaatacacaagtgtcgcggtaacgggcgcacacggcaagacgtccacaacgggcctcttggcacacgtgatgcagcaggcgaagccgacttcgtttcttatcggggacggaacgggcagaggaaatgaaagcagcgaatactttgtatttgaagcttgcgagtaccgccgtcatttcttaagctatcagcctgattatgcgattatgacgaatattgattttgaccaccctgattatttcgccaacattgacgatgtgtttgatgctttccaaaacatggcgcttcaagtcaacaaaggcatcattgcctgcggtgatgacgagtacctgccgaaaattcacgccaatgtgcctgtcgtttattacggcacgggagaagaaaacgattttcaagcgagaaacatcgtaaaaaatacggaaggcacgacatttgacgtctttgtccgcaatacgttttacgatacgttctacatcccggcatacggccatcataatgtcctcaattccttagcggtcattgcgctctgccactatgaagaaatagacgtgaacatgattaagctcggacttgaatcattcggcggcgtcaaacgcagattcaatgaaaaagtgatcggcagccaggtactgatcgacgactacgcccaccatccgactgaaatcaaagtcacgattgaggcggcgcgccaaaaatatcccgaacgtgaaatcatcgcggtatttcagccgcatacgtttacacggacgcaatcattcctggatgaattcgcagaaagcttaagcgcggccgaccgcgtgtatctgtgcgacattttcggctctgcccgtgagaacgtcggcaagctcacgatcacggatcttcaggaaaaaatcgataacgcagaactcattgaagaaaatgacacttccgtgttaaaagcgcatgaaggcgcagtactgatcttcatgggcgccggagacattcaaaaatatatgagggcctatgaaaacgtcatagcgtaacgaaaaagcagtggggctctcactgcttttttgcgcgtgctgcaaagggatttaccgataaacggagaaatagtatacatacagacctttcatatatgtttatcattttaagaattgggtatataccactatatcctgcattaaggaggtattagatgatcatcattctttacttaagcgtcgcactcattgccgttgcatttctcatcctcgtcatctatctgtccaaaacattaaagtccgtgcagatgactttaacaaacgtagcctcgactttagacggccttgaagggcagatgaaaggcattaccgcagagacaaccgagctgttacataagacaaaccgtctcgcggaagacattcaggaaaaatcagagaaattaaatacggttgtccatgctgtccaggaagtgggaacttccgtccagcagtttaatacatccataaagcaggcagcaggttctgttacggcctctgtaagagagaatcaggataagatcagtcaggttgtcacctggagccaggccgctatggaaatatgggacaagtggaagcaaaagaaaaaaacatcgctttaatcataagaaaaatccactaaggaggaatcataatgagcaaagatggaatcaatagtaaggattttttaatcggaacgctgatcgggggaattatcggcgcgacaacggcgttgtttctggcgcctaaatcaggtaaggagctgcgcgacgatctcggcagtcaggcttctgcgttaaaggataagacggacagaatgacggccgacgcgaaagaaaaaggctctcaatatgtcagcatcgccaaggacaaaacatctaatatcacccagctggtagctgatcagtcaggtcagattatgaataaagtgaaggatttaaaagaccgttctaagagcacactaaccgagaaagccgaagagacgagaagcgaaatgcaggacacggcccaaagcatcaaggccgaagcggaagacgccggggaaaaagccggtcaggcaaatcgctgatcttcaataaggagagataaccgacatgacaaaacagctgatatcgtctgaagaagagttcaaaaatgccgctgagaaagaaaacacgctcgtgtttttaaaacacagcacaacctgcccgatcagccaagccgcgtttcaggagtttgacgcctttgcatcggagcattcagaagtaccttcttattacctgcatgtgcaggacagccggccgctttcaaactatatcgccgaggcatacggcgtgaaacatgaaagcccgcaagtattcgttattacaaacggcgaagtgaaatggcacgcgtctcattcacaaatcacaaaaaacgcaatagagcagcacctttcataattgctggccgccggttgataccggcggtttttttttgaaaaaaactattgatcatttcagccggatcatgtaggatatcaatatatactgcttcaacgcataaaagcttaaaagcgtttttgtgataaagtcgaatgtgaaaaaatttattatttcatattcctattttcgcataactgtagtaagatgcatgttaaccattaaaataaaacatagcatagaagggatgaaaaagatgagcaacaaggaattagagagtctaagacagcaggcagacgcactaaacttagaaatccttaaattaatcaatgaacgcggagccgttgtaaaagaaatcggtaaagcaaaggaagcacagggtgtcaaccgatttgaccctgtcagagagcgtacaatgcttaaccgcattattgaaagcaatgacggcccatttgaaaactcaacgatccagcatattttcaaagaaattttcaaagccggacttgaacttcaagaagaggatcacagcaaagcgttgctcgtctcccggaagaaaaaagcagaagatacgatcgttgacattaaaggtgaaaaaatcggtgacggcgatcagagattcatcgtcggaccttgtgccgtagaaagctatgagcaggttgccgaagtcgcggccgcagcgaaaaaacaaggcattaaaatcctgcgcgggggcgcgtttaaaccccgcacaagtccgtatgatttccaaggtctcggcgtagaaggcctgcaaattcttaaacgcgtcgctgatgaatatgacctcgcggtgatcagtgaaatcgtaacgcccgcccacattgagcaagcgattgattacattgacgtcattcagatcggcgcgcggaacatgcaaaactttgaattgctgaaagccgccggttccgttaaaaagccggtattgttaaaacgcggtcttgccgcaacaatttcagagttcatcaatgcagctgaatacatcatgtcacaaggaaacgaccaaatcattctttgtgagcgcggaatcagaacgtacgaaacggcaacgagaaacacactcgacatttctgccgtgccgattttgaaacaggaaactcacttgccggtgtttgttgacgtcacacactcaacaggccgccgcgatctcctgcttccgacagcaaaagcggcgcttgcgatcggcgctgacggcgtgatggccgaagtacaccctgatccttccgttgccctttcagactctgcgcagcagatggatatccctgaattcgagaaatggctgaacgaattaaagccgatgctgaaagtaaaagcataatacaacgttccgctctttaaaggccgcctcgcgcggcttttttttcgtatcttcattttatttaattataaaatgaaagtgaacgttttcatcattgggaaaaacgtgtataatttcatgagagatatttaaatttgatgaataatgaaaaataatgtacactactgacttacgcttacaatcataaacgacagaatgcgaaatcgtacgacatttctttacataaagtgtttatgctatagataaggataagtgtatccagtaaaaggagtggtttcagtgagcaacattacgatatacgatgtggccagagaagcaaatgtcagtatggcgactgtttcccgcgtcgtgaacggcaacccgaatgtaaaaccgacgaccagaaaaaaagtattggaagccattgaccggctcggctaccgcccgaacgcggtggcaagagggcttgcaagcaaaaaaacgacaacggtcggcgtcatcatccctgatatctcaagcattttctactcggaacttgcgcgtggaattgaagatatcgcgacgatgtacaaatataatattatcttaagcaactcggatcaaaatcttgagaaagaactgcatctgttaaatacgatgctcggcaaacaagtggacggtatcgtatttatgggcggcaacattacggacgagcatgtcgaagaatttaagcgctctcctgtgccgatcgtcttggctgcatcagtggaagaacagggcgagacgccttctgtcgccattgattatgaacaggcgatttatgatgccgttaagcttttcattgataaagggcatcgcgatattgcattcgtctccggaccgatgcaagagccgatcaaccgttcgaaaaaactgcaagggtacaaacgggcgcttgaagaagcggcgattccgtttaacgagcaattcgtagcggaaggcgattacacttatgattccggtatggaggcgcttcaaagcttgatgggccttgaccggaaaccgacggcgattctttctgcgacggatgaaatggccctcggcattatccatgcggcccaagatcaaggtctttcgatacctgatgatcttgatattatcggttttgacaatacgagattgagcctgatggtccgccctcagctttcaacagtcgtgcagcctacgtacgatatcggcgccgtggcgatgagacttttgacaaaactgatgaacaaagagccggttgaagagcatatcgtcgaattgcctcaccgcatcgaattaagacaatcaaccaagtcataaaaaaacggaaaagcaagcttcactctgaggggtggaatcttgcttttttacttgagtaaggagaagatatgaaacgttttgattatctgacgcccgttggctttatgttaggctgtattattgtcgcaatcggtattctgtcagggacgggactggcgggaatcagttcatttttggatctgacttcttttttaatcgtcacaggcggccttgccgcggcggtctttatcagctttccgccgagggatttaaagaaaaccccttctgttctgaaacaggtattctcccgtcaggatgacaatgtgaaagagcttgtcagagtatttgtcagcctttcggagcaggcgcgcaggcaggggctgctgtctctggatgaccaggcgcgggagatcaaggatccgtttttaaaaaaagggcttttgcttgcgattgacggctgggacgaggaaacgatccggctggtgatggattctgagatcgccgcaatggaagaaagacacagaaaaggaagacgcgtttttgaaaaagctggtgatttcgcacccgcctggggaatgatcgggacgctcgtcggactcgttctcatgctcaaaaacttaaatgacccgcataccctcggaccgaacatggccgttgcgctattgacgacgctgtacggagcgctgcttgccaatttggtgtttatcccaatcgcggcaaagcttgaagaaaaaacggaaagtgaaattttcatcaaacaggtcatgatcgaaggggttgtcggcatccaatcgggcaaaaatccccgcaacctcgaaagtcagctcgtcgtcttcagctcaagagaagactggcgtaaaggacagcctgcgaacaagaaaaagggcgctgtccatgaagcttagaaaagagcgttttgaaagaagaaacaaaccggaacattccggcggttcaccgagatggatggtgacgttcgctgacttgatcacgctcattctcgtgttctttatcttgcttttttcgatgtcgcaaatagacgcggaaaaatttcaatctgccgtttcatcgattcatacaaacggcagcggaggtgaaccggcgtcatcagacaaagcaaacgaaaataaagaacaggatttgctgttacaaaacgtgaagacatacataaaagcgcatcatttgagttccaaattgacggcgaagcgcgatgagcgcggagtggttcttgtgctgcaggaggccgttctgtttcagacgggaaaagcggatgtgctgaaaaacgccgagccggttctgcatcagatcgcggtgcttttaaaaacaattccgaatgacatacaggtagaaggccatacggacagccgccggatttccacctatcaattcccgtcgaactgggagctgtcgtctgcaagagcggcgagtgtgatccagtattttaccgcgaatgaagacttttccgccaaacggtttatctctgccgggtatgcggatacgaaacctgtgaaggacaacaaaagtcccggacatatgaaagaaaaccgccgtgtagaaatcgtgatcaaaaaaacgacctcctcataaggtcgttttttattttgttttataccgctgctcagaccggatggcaaaaagtgctttttccacggtttgggcatttttttctgaaatttcttctttgcgtggaatcggaggatataattgttcaggatcactccaaaaagcgggcagcgtgcagggggaatgcttctgccatttatcaatccatttctgcggtatgcgctccccgggatcaatccctttcatctcaagccaaatgcggctccatgctctcgggacgactctccaaatatcgtatccgccgccgccgaccgcgatccatctgccgctgcaatattgatgggctaatgaatgagcgagccgcgggatctcctgataaatggagattgtattggacaggtgtgtcaatgggtcgtaataatgggcgtccgcaccgttttgggtaagaatcacatccggcttaaaaaaagccgcaatttcagaggcggccgttttgtaagcgtggagaaaggaatcgtcctctgtgaaagcgtccagcggaatgttaaaagaatagccgtagccttgcccgcttcctttttccagtacttgtcccgtcccgggaaataaataacgcccggtctcgtgaaaagaaacagtgcagacatcagacctgtcgtaaaacgtaaattgaacgccgtcgccgtggtgggcgtctgtatcaatgtataacacttttgccccgtagttcttctggatgtattggatggccacggcgctgtcattatagatacaaaagcctgacgccctgccgcggaagccgtggtgaaggcctcctcctaaattgcaggcatgcctggcttgtcccgtcatgacataatctgccgccgttaaggtgccgcccaccagaagcgacgcagcttcatgcatgccggcaaaaacgggggtgtcttccgttccgagaccgtagctttctccttctgcggcagggagccggcccgcacccgcaagttccaccgcctgtatataatcctccgtatgaacgagagccagctcttctttagtggccgtgcgcggtttgacgatgtctccatcgtcaaacgcgtccgccgcctgaagcagatcgtatgttaaaagcacgcgctgctgattgaacggatgatcctgatgaaattgatacgtctgataagaaggcgagtaaacaaaaacgctgtctctcatggctgatccctcaaatgtttcggccataagacattgtatccggcttcatgaacggcacggataaaagggagcggattcatcgtcttcacccggaagacgagaatgttcgacccggcggaatcatggggatagacgagcacactcaggatttgcagctgaagatcacggcacatgcagctgagatcagcaaggctttttgtcatatccgtcaccaggatttccacctgtgatcccggctgggccgcgcctgtcaggctgacgaaagtccggagcacgtcggttttcgttaaaatgcccgtcagcttatgatttaccgtaatcggcagacagccgatgccgtgctcataaaaggaagcggatatttcttccacaaagtcaagcggatgggcgcagatgacattccgcttcataatggtctccactttgtttgtcagaaacgcgccgcgttccttttgttcgaagctgccggggccggcctgtttaatgtctctgtctgtgacaataccggtgacgtgcagctcgtcgtcgatgacagggagatggcggatatgatataccttcattttacggacggctgtttcaatggagtcgtgttttgagacggtgatgacgtcccgtttcatgatttgttctgcaatcatctttttatcccctttgtatgtcagtcaatacataaaccgctgataaaaacgaagcctgtcgaactgttcaattgactcctgactgacgtgcctgccgatgcgggccatcagacaattggccggatgagagctgatttccggttcatccgttgcaaaccagacaagacccccggcattcatcatcttttccatgatctttctgtattcccacacatcttttttcattccttttaaatcccaatgccagtaatattccgtcgtcatgatgatgtagcgttccatctgttcatccatcatgctgactgtcagcaacgtttttccgacagaacagccctgtagccgggagcgacctcgatcgccccgagctcaaggagatcttccatattgccgtcagaccaccgttcaagcggatcaggatataaatacgtcacatagccgataatcgtctgtccgtccctggcgataatgatccgaccttcaggaagcccggcgatctcgattaacgctttgtgctgttcatgaggaaggcgaaaggctgtcaggccttcatgaaactcatactgtgctaggtcctttggaggaacgggcccttctaccaatagagggccggctgctgtctgaattgatgaagaatggtacgttttatgatgtttcactgattcaccgcctgtcggttcttaataaaaacacatctctcttaagcataacaaaatataaagcgttttcaatagtgttgtaatttatattttaaaaattgagaaaactgtgaacatctactataattagtctatagataagcaaagggggatgttgcatgaatttgaaagcgttgccggcggaaaaggggaattatcatctgcgaaattatgaggaaacgtaccgcagcttcgattggaaagaggtcgaagcggagttttcctggcatcagacggggaagctgaatgcggcgtacgaagcaattgaccgtcatgccgaatcatttcgaaaaaacaaagtagcgctgtattacaaggacgcaaatcggaatgaaaaatacacatttaaagaaatgatggaggaatcgaaccgggcgggaaatgtactgagacggtatggaaacgtggaaaaaggggaccgcgtttttattttcatgccgcgttcgccggagctgtactttatcatgctcggcgcaattaaaatcggtgcgatcgccggccctttatttgaagcgtttatggaaggcgccgtcaaagaccgcctgttgaacagccaggcaaaggttgtcgtgacgacacctgaactggccgaacggattccggcggacagcctgcccgacctcgagcatattttcattgtcggcggcagcaaagaagcgggagataaaatcattcattatgataaagcggctgagggagaaagcacgagacttgatattgaatggatggacagaagagacggctacctgcttcactacacatcaggatctaccggaacgcccaaaggtgtgctccacgttcatgaagccatgattcagcaataccagaccggcaagtgggtgcttgatcttaaagaagacgatatttattggtgcactgcggacccgggctgggtgaccgggacggtgtacgggatatttgcgccgtggctgaacggagcggcgaatgtgatcgtcggcggcagattcagtccggaaaactggtacggcacgattgagaagctcggtgtcagtgtctggtacagcgctccgacggctttcagaatgcttatgggcgccggagatgaaatggcatccaaatttgaccttacttcacttcgtcacgtcctgagtgtcggagaacctttgaaccccgaggtcatcaagtggggacataaagtattcggcaagcgcatccacgacacgtggtggatgacagaaacgggcggacagctcatctgcaattatccttgcatggagatcaagccgggctcaatggggaaaccgattccgggagtggaagcggcgatcgttgacaatcagggaaatgagcttccgccgtaccgaatgggaaatctcgccattaaaaagggctggccgtcgatgatggattccatttggaacaacaaagagaaatatgattcttattttatgccgggcggctggtatgtttccggagattctgcttatatggatgaagacggttatttttggttccaaggcagagtcgatgatgtcatcatgacatccggcgagcgcgtcggcccgtttgaagtcgaaagcaaacttgttgaacatccggcgattgccgaagccggcgtcatcggaaagccggaccctgtccggggagaaattattaaagcgtttatcgcgctcagagaagggcatgagccatccgatcagctgaaggaggacattcgcctctttgtaaaacaggggcttgccgcgcatgccgcaccgcgggaaattgaattcaaagataaacttccgaaaacacggagcggaaaaatcatgagacgtgtgctgaaggcatgggagctgaacctgccggcaggcgacctgtccacaatggaagattaaagacggcgttgacatcgtatcttatttatgttaaaaatgagtaagcttcatacgaaaaggttttgattgagacaagtaggatatctgattgttccagagagctgatggccggtgaaaatcagcacataagatatgccgaatacactcatgaaccgcttttgcgaacaaagctattccaaggctttcagtagtgaaagaacggacacggtccgttatcaaaaagagtgataaaagcttttttatgtttttattagtagggtggtaccgcgattatatcgtcccttcgttttaaacgaaggggcgttttttattttcataaacaaaggagcagacaaaatgactaacttattagaggatttatcattccgcggcttaatccagcaaatgacggatgaagaaggactgaataaacagctgagcgaagaaaaaatccgtttatactcagggtttgacccgacggctgacagcctgcacatcggacaccttctgccgatattgacactgcgccgtttccagcttgcaggccaccatccgattgcgcttgtaggcggcgcgacgggactgatcggcgatccgagcggcaaaaaagcggagcgtacgttaaatactcaggatatcgttgtcgaatggtcgcaaaaaattaaaaatcagctttcccgatttttagatttcgaggcaggagaaaaccccgctgtcatagcgaacaactttgattggatcggaaagctgagcatcattgaatttctccgtgacgtcggaaagaacttcggaattaactacatgcttgcgaaagatactgtaagctcaagaattgaaaccggaatttcttacacggaattcagctacatgatcctgcaatcctacgattttctgaatctgtacagagaaaagaactgcaaactccaaatcggaggcagtgaccagtggggcaacatcacggccggtcttgaactgatcagaaaatcagaagaagaaggggcgaaagctttcggtcttaccattccgctcgtcacaaaagctgacggcacgaaattcggcaaaacggaaggcggcgccatttggcttgataaagaaaaaacatcgccgtacgaattctaccagttctggatcaatactgatgaccgcgacgtcgtcaaatacttaaaatactttactttcttgtcaaaagaggaaattgaagcttatgctgaaaaaacggagacagctcctgagaaaagagaagcgcagaaacgtctcgctgaagaggtgacggttcttgtacacggccgtgaagcgcttgagcaggccgttcatatctcccaggcgctgttcagcggcaatattaaagagctttccgctcaagacgtcaaggtaggatttaaagatgtaccttcgtttgaaaaagaccgctctcaagaactgtctttagtagacgtgctagtggaatctaaactgtcgccttcaaaacggcaggcccgcgaagacattcaaaacggagctgtttacattaacggcgagcgccagacggacatcgggcatcttctgactgcggaagaccgcattgaagatcaatttaccgtactgcgccgcggaaagaaaaaatacttcctgatcacgtactgaaaataaaaagcagtccggccgctccatgcggcaggctgcttttttatgttttgtgaatactgcacggggaaatgagtacagtacatagtataagcaaaacagggaaggggtgctgcgccgtgaatttcatgtttaccatcgccaaagaaagattgcagcgggatcattgggaacagcagcaaagcataaacgccgaagccgaggaatcagagacggaagaagaaaatccgacatcataaaggtaaagcctccattctatggaatggaggcttttgattgtcaccatatcagcctgacggcggccatcagcacgactcccgtgatgaccgtgatggataagctttttgtcagcatcgcgcaaagcaatgtcgggatgagaacgatcattgctttccaatcaaaggtcaaagcgctgtttgttttcacaatcatgttttccgttaccagagccgtcaaaatgcaaagcggaataaaggagagccattttaaagccaattcaggcatctgaatgttccggacaaatataaacggaacaatgcgcggcacaagtgtaacaatcatgcagccgagtataatccagatcatttgtgtgctgatgctcatttgtccgtcaccaccccgatcgttgccacaattacggttgagacgatgaccgcgatgtgtgacgggacgaaatacgataacaagaccataaaaatgatcatatagagaattaaggagaggctgtgcttcagcttttccgaagcggacgactgcaattgcagcacaagcagcgccgcaaacatagcgggcaaagcaaagtccaggccgagagcgtaaggatcagatatccattgtccgagaagcccgcccatcacgcaggaaataacccagcacatgtaagcggttatattgaggccgttcatccacttatcgtataacctgccgttctgagccgctttgttcaccgctactccgaaagattcgtcagtaagcagagccccgaagccgatatttttcgccagagagtatttcgtgaaatacggcgcgatggtcaggctcagcagaaggtgacgcagattgacgataaacgtcgttaaaataatggcggaaatcggactcccggaaacaaggagcgagcaaataataaattgggcggcgccggcatagacacacaaggataacaaacagatttcaagaatgcttagatgagaggcaaccccgacgatgccgaaagcaaaaccgatgctcatatagcccagcagcgtaggcacacaatcccgcaccccctgtaaaaacgtatcgttcatttcccgggaaacggcggttttttgcacttctgtattaatcattttttatactcctttcatagagattataatgataacgactaatgaaaaaatcaaagaaaatacggttcacatttatatgaaccgatttccggtgacgacatgaaataacgaatggttttgtttcatcaggccttcaactttttcagccccgacttctttcacaagctctgcgaacatcagatcgtgcctcatatattccatggccacgagaacgagagcggggtcttctgatttaatggcccaggcattcgtctgcggagaaaaattggcgattaagacttctttattatctcgggcagctatcgttaatcttccgcccatccgtttctccgccacttcaggagacatattatgatttgtcgtatttccgagcttcacttccggagggccgaacacaatcgaaaagacgggcaattgttcggcggcgcgtttattagcggcttcttgaataaagggaatctgctgttcccagacagacagccacaactcttcctcggctttttcaatcatttccttcatctcattgatgacatgatcatttgtgctgatgcggcggatgacattcatctcctgctcgctttccagcgccaataacttttcctcaaggtagccgaatgagctctcgaaatcgtgccggagccggtcgattaattcctttccggccagcggggcatatgtaaccggatcagacggcacaatatggacagcgcctttatcaactaatttccccaatacctcatagatcattgagcgggggacgcctgaccttttgctgatttcatatccggtaacaggcgagtgtttcaacaagccgatatatgctttacattcatattgagaaaatccaaacttctgtaattctttcagaacatcatccataaacatcctccgtagtggttattcatgaaactactataatgtaagcggttatatcttgtcaatgggacttgagtgctgaaagaaaggttcgcctgttttgtcgctttccaacttagtttatgatgagttacatgtatggcttttgtgaaaaacgttgccgtagacccacacgaatgccgtttgatacgataaatacaagaagtcaaaaagaggaggatcacggtggaaaacacctctaaaatcgcttttttatcggttataagcaattccctggtcgtcatgctcaaaatagtggtggggataataaccggatctgtcgcgatactttcagaagccattcattcttttttagatttgatcgccgccttcatcgcctttatctccgtcaggatttcaaaaaagccggctgatacagggcatccgtacggtcatggaaaagtcgagaatctgtcggggaccatcgagacgatgctgatttttgcggcagggatttggatgatatatgaatgcgttcaaaaactggtcaacccggctccggttcatctgcccgtattgggaatcgttgtgatgcttgcgggggctctcattaatttgatcgtttcgaagttcgtaaaaagagaagccgaaaaggttaattccgtggcaatgaaatcgaatgccctgcatttactgactgacgtgtacacatcattaggcgtagcggcaagccttttggtcgttaccttaacggagtggtacatacttgatcctattataggtatggtgctggcggtgtatatcatatatgaagcgtttaagttaatgaaagaagcattcccgccgctgattgatacccgtttgtcggaagaggaagaaaaaacaattttaaagattatcgaaacatttcaacaggaatttattgaaattcacgattttcgtacaagacgctccggcccgcaggagtatattgattttcacttggtcgtagcctctcacgtggcgattaaagacgtgcacgacctgtgtgaccgcattgaaagagctattacgaatgaattcaaacaagcacaggtaatgattcaccccgagccggagagcgagaggaagaaataaatcgatcttaagtttgcgtttgttccctgcaaaatgcctgcaaaaggcccgtttccacgggtctttttgttgtataaatgactatttctcgctcatatgagagagaagcttatacacgtgaggggtacatttcatacgttatgttgtaaagaaaaagggaggtgaacagaattgaacgctatttctgttaaagaaattgaacatggagttgccgttgcggaaagagaaggtttaggggagtatttataccaagaaccggtttccaaaaaatgttcgcgccgttcccgcagcagaaaacggacacaccgttcccgcagcagaagacggagtcatcaccggacacaccgctcccgcagcagaagacggacccatcaccggacacaccgttcccgcagcagaagacggacgcatcaccggacacaccgttcccgcagcagaagacggacgcatcgccggacacaccgttcccgcagcagacggtcacatcaaaaacgtacccgcaagcgctgttttaaatgctgaagcagactctattacaagtaatggagatctgctataatggcaagagaactgcataaaagatccggtatcatcatctgcggacactgaactgacaacatggcgctgtttgttcgtgtccgttttttatgtcaaaaaagatgccggaggataaaaaggaagggatgacgccgaatgaagctgaatgaggaattttataactctgaaggaaagacagtctcttcgcaaaacataagcagcaagcttttgcatatcacggacagcgggcatatcagcattgacttcatcagcataagcaggctgcggaaggcttcaaaaatcgcgatcttaggtgacagcgtcgcccgggggctgcgcgcggaatacggctttggtgacattctgaaagaccggacagacgctgaaataaccaatctgtctgtcagcggcgttaatatgagcaaccacggaagcgataacatttatcagcaagcgcttaaaacaaagggacatgatgtcatcattgtccagggaacagatgatgattggtgcaaccacattcccatcggcacagatgaaaaggatatcaccacattttacggaggcttctgtcaagtgattcagcagctgcgaagcggaaataaaggcgcgagcaccattgtggtgaccccaacgagacaagcaaaaatatcaaaaggaaaaatcgtccgccgtgatactgataaaaataaactgggcctgaagctggctgactatgtgaaagcccaaaaagaagcctgcacactcctctctgtaccgtatgccgacctgtttgatacagatctcatcgacccgtataatcccgctttccgcagcatgtgcatgtcagaaggtcttcatccgaacgagaaagggcatcaaatcatttttcaggaaatctgccggaattattattactattacgggtaacacagcgctgcatgattattttcggccttgcttttctaaaagctcaattattctttgagatgcgtgtttttgcgctctcaaaagcgaaatgatattaccggtaaaaccgattaaaatgatcagcagcaaaatgatcatccacataagtgaacctcccgtcgagtgttgaaaaacccactctttattttacttattatggatggggaagagaataggtctaactattggtgtttctttatcaatccataaaaaaatgcacagactgaacgggtctgtgcatttttattcgcttatttcagcaggttcaatgattcacgattaaaggcttccaaatcgtcaggcgttctgctcgttacgatgttatggctcacgatgacttcttcatctttataatgtgcgccggcattgattaagtctttgcggatgctgcggaatcccgtgatatcttttcctttaagaaggtcggtatcaatcagcagctgcgggccgtggcagatcgcgaaaacgggtttctgattttccacgaatgatttagtgaattcacccgggcggtcatctccccgcagaagatctggtgaaaagcctccgggaatcaataacgcatcgaattccttggggtctgcgtctgagatcgcttgatcgatctttactttctcaccgtgcttgcccgtcacttctttccctgcttctaaatctattgtcaccacactgtggcccgcttctttaaatgcttccgccgggcttgtatattcaatatcctcaaattgatctgtcatcagaactgcgatttttttgctcatcatcatgcctcctgtgaatttgtatatgacaagaatatcaggcggattgccgcctcacaacgtatttgcttgaagatacggcatgaaaaaagacccctctgaaaaagaggagccaaaaggtacggaggtctgctgaggcaagaaatcgaaccaattactttttgcgtctttttttatcctttttacacccgcatttccccggatcgcccggatcaatgacttcgtgaattgtttcttcctgataaacgtggcggggaacataacggatatgttctctgttaatgtgtttgatgggatggacgtaaaccacttctttgtcagtatacttgtcagtcacaatatacttagggtcacagtaatacactttcgattttttacccattcatctcacctcccgtactttattaaatgctgaaaaggaggattttgcatcggacaagtacactatggcaagtccacaattttccatccgcaatttcgtttatctggtttttcctgaatccgtctcaaattggaatggctaaccctttttgaacggggaaatctataaaaaagaattcaaaaacgattcttttttcaggtcaatcgagatgcatacatctttagggggatttcagaatgctcgatgaaaaaacgattgaaatcattaaaagcacagtgccggtcttagaagagcatggtgaagaaatcacaggccgattttatgacctgctttttcagcatcaccctgagctgctgaatatctttaatcagacgaatcaaaagaaaaaaacacagcgtacggccttgtcgaatgctgtgattgcggccgcagccaatattgaccggctggaaaacatagtccccgtcgtcaaacaaatcagccataagcaccggagtatcggtgttaagcccgagcattatccaatcgttggaaagtacttgttaatcgcgataaaggatgtgctaaaagacggggctgctcctgaggtcattcaggcatgggaaaaagcatacggcgtcattgcagacgcttttatcggaattgagaaggacatgtataaacaagcggaaacgcaaaaaggcggctggaaagacgataaggcgtttaaaattgataaaaaggtaaaagaaagcaaagagataacgtcgttttatttaaaaccggaagacggacaagttctccccgaattcaaagcgggacagtatatcagtgtaaaagtatacattccggacacgggttatacgcatatccgccagtacagtttgtcggatgtatccggtaaggattattaccggatttccgtgaaaaaagacggaattgtttcttcatatctgcatgaccaattacacgaaaaggattcaattgagatcagcgctccggccggggatttcgtattagaccctgattccaaaaagaatctggttctcatcagtgccggtgtcggaattaccccgatgatcagcatgttaaagacggttgccaaaacccagccgcagcgaaacgttctctttatccatgcggcaaggagcggagagtatcatgcgctgcggcatgaagctgaagaagccgcggaacactcatccgctgacaccgtctttatttacagcgaaccgtccgaacaagaccgttcagaaaacattcgttttcgggaaggccggattgacaaacagctgttagaagaagtgatgacagataaagatgctgatttttacctgtgcggatccccgtcgttcattaaagaaatgaaaaagctgatttctgaattcaatataacgccggaatccattcactatgaattatttaaaccgcagctgagtatggtgtgatgtaacaacatcttagacagtctgtttaacagactgtctttatatgtttaatacgaaaggttttccccataacatagaattttcaagcaggtaaatcatattcaaagtcgtattatcctaaaaagacaaagttttttatgtcccaacatacttcagtagccggatggaaaggttctcttcctgatacttcaactggaacattggctcctgctcttgtgaataaaatagcaatgctctaataataagaggtggctcaatggcagtttttgttgaaaaaacgctccaaggtctaaaagaattaattgatgaaaaaggccgcttgaacattttagggaatgaaggaacgcttttagaaacagaatgtactttctttaaaggtgcaacagatctggagattgagagttttgagaagaaaataaaagtctcacttcctgaagattataaaacctttttaaaattgcataacggagccagaatatttgatttgttgatttacggtgagaatgtaggtgggggtttgcatattcttgatttagaagagattgaaaagtatatgcaaaatggttttttagagcctcagtttattcctgtcgcacatctgttagacggatgttatttgttaattgacaaaaccaaaatttctacagatccaaactatttatggttccgcggatttattgagtatgaaccaatgaaacttaattttgagatatttttagatcggtatattttgtgtcaaggagcaaatttttgggagtggaatatctataccgctgaaaattattataggactcaccagggtgataaggattaacctttcctacagttgggttggttcatttttgcggttagacttcgatttgaacttttaaaaataggtttaatttgggagacgaaccgattaattggtgtatagatgatttataaaaagcgcagatactctgcgcttttttatttaagtattttccggatcattcgcagcccgtttttggaagaaggataacggaaagcgaggtcgaagcggttcgtttgtttgacgacgctttttttgtgcgtaaatgcgttaaagctgttaaatccgtgatagctgccgatgccgctttctccgacgccgccgaatggcaaatacggtgtcgcgacgtgcattaacgtatcattgacacagccgccgccaaatgacagattctctaaaacagttcgctcgattcctttgtttgttgtgaagacataaagagcgagcggctttgggcgtgattggactttctcgatgacttcatcgatatcgccgtatgtaaacagcggaagaatcggcccgaaaatctcctcctgcattactggagagtcatccttcacttgatctagaatcgtcggcgctattttgtggtgttcaggattaaattgtccgcctgtaagcgggacgccatcattcagaaagctgagcagccgctgatagtggcgttcactgacgattttgccgtactgcggattttgttcaggctgagggccgtaaaattcactgatcgcatgcttcatttcttctatgagcttcgttttgatatcttggtggacaactaaataatccggtgcgatgcaggtttgccctgcatttgtaaatttcccgaagacgatgcgtttggcggcaagctgtatatcagcatccttatggacaatgcagggacttttgccgccgagctccaaggtaacgggaattaattgtttggaggcggcctccataacgatttttcccacggcaacgcttcctgtgaagaaaatatagtcaaagggctgctgtaataaaacagtgctgacgtcgggcccgccctccgccatagcgacataatcactcggaaaaacgctgctgataagtttagaaagaacagcggaaaccgcaggcgtatattctgacggtttgagaacgactgtgtttccggccgcaatggctccaatcaagggtgaaagcgccagctgcaagggataattccaaggcgcaatcaccaaaacgattccatatggctcagggataatcatgcttttcgagcccaggtgagtcagaggcgttttgactcgcttcggtttgacccattttctcagccgcttcatcacaaaactgatttcttccagaacaattccgatttctgtcgtgtacgcctcctgttcggatttgtggagatcctgatagagagcggctgctatatcggcttcttgtgttttgatggcttgtttcagcttttgcaatatgttcagccttgattctagcggtctcgtatgccccgccgcaaaataggctttgtgcttgctgacgatagaggggatgctgttcattccgtctctcctttttgtaagtatgatgattcattatgtaaaaaatcgcttctgcctgtcaaatgattaaggtgagtcagaaaaaataacaaactcatttctgcgtttcggcaggaatttgatgaaaaagagaattctttttgcggcattatctgttgcaggcattatggggttttctaatgtacatgtagttgaaaagccggttggcacataaaaaaaagccccggacaggggcttttttaataaagagagggaacagcccaaaagaaaaaccccggaaacattgtcatcacaacatgtccggggtttaatccaatgctctttaaagagcgttttacttaacgggagtagaactcaacgataagcgcttcgttaatttccggagcaagctcagagcgctctggaagacgagtgaatgtaccttcaagcttttcagcgtcgaaagtaaggtactcaggaacgaagttgtttacttctacagattctttgatgatagaaaggtttcttgatttttcgcgaacaccgattgtttgaccaggttttacttggtaagacggaatgtcaacgcggcttccgtcaacaaggatgtgaccgtggttaactaattggcgagcttgacggcgagtgcgtgcaagaccgagcttgtacacaacgttatcaagacgtgcatctaaaagaatcatgaagttttcgccgtgtttaccagtcatttttgccgctttgtcaaacaatgtgcggaattgacgttcgtttacaccgtacatgtgacgaagtttttgcttttcttgcaattgcaaaccgtattctgatagttttttacgctgtcccggaccgtggggacctggtgcgtaagggcgtttttctaattctttacctgtaccgctaagagagattcctaaacggcgggacagtttccaagatggacctgtatagcgagccataatgtgactcctcctttggttttattttgtggaaaataaaaaccgtctgttcgatccgaccgtgcacattttgttttcatgtatcctcgctccagcagcagagagttacacgatacaccttacagctaaggaacaaaatgcaaacacagaagctgaacaaaaaggctgcaatatttcacacaaagaacattatatgatttttccccgccgccgtcaaccatttctccatgaagagtgccggtttatgatataatgtacaaaaatgagtagtacatgtttaggtgataaaaatgaaaaaacaaacaattgatgaagtgacggcctttcatcagaaaatgctttcttttttcttaacgaaatctgaatccgtctcattatccgactcgctgttatggctggcctcagctctagaatcctgctttacatctctttcattgaccctttcaccggcagaatcaacacgtttcaccataaaaacagaagatgaaccgcattatgctccgctgaaagagagtgacggccgttttatgatcaggaatcagacgtccggcagatccttttatctgcgctcggaaggcgggctgccgatcccggaatcattgcctgagatcgttactcagtttatcaatcaatctgtgagacaaagcgggctgtttgacaaaacgaagcatcagcggaaaattcacagaatgacagaaatgttccattcgcttttggatcaaaatgaggttttggaaaaactgcaggcaagtttgagtacggctttccggtctttccgcttttcactgtttatcacgcaggatcaggatacggacagacagcttcccgcaaaagaattacatatggatggaaaagatgccgatccgtctgccctgaaggtttatttatcggggagactgctcagaaaaggcaggtcatctgcttacctgccgatcaaaggccagcaggggacttacggggttctgaagacggaggggctgcaggatgccgttctttcgtgcagtactctcagtgaaatgctgctgcttgcgggcgcggcgggaaaagcatttgaaaatgcgcagctctatgagcaatcgaaaaaaagcattgcgaatctggagctcattaatgaaacatcgcgccagctgaatcagcgcctcagactcactgacacgatgcgggaactcgccgccattatgacccaatcatttcatgcggaagaagtggctttttttcatattgatcattttgagacgcaaaatctgcttccgggacataccgctttttttaagacagaacgtgcgaacccctatatcagcattgtgaaagaaaagctgttcgagggagaaaagggcgtgtttatcggcagcggaaagactgtattcggcgaaaacggcttcggctcgctgatggcggtgccgatgatcgaaaatgacaccgtcttcgggttcgcgattttattgaaaaaggatttgtatgcttttacgtttgaaatgtataagctttttcaagcgctcattcaccatgcgacattggcggtcacgaactccatgctgcgcgacaggcttgagcatcttgttcagacagaccagctgacggagctgtattcaagaacctatttggatgagaaaattcaatacagcatgaaaattcataaacggggtgtattcatcctcgttgatatcgataatttcaaaaccattaatgatacatacggtcatcaaacgggagattcgatcctgattcaggtggcctccgttatgaaaaaccatattcgtgagcatgatgtcgctgcaaggtggggggcgaggagctggctgtctatctgccgaatatcaacgtgtcatccggagaacgcatcgctaaaaggctggttcgcgccatccgggaaaacaccgagccgcgcgtgacgatttcctgcggcgtttcctgctggtcaaagacaggcccgatgccgttgaaaatgctcgttcagcaagcggacgaggcgctttatatcgccaaacggaacggcaaaaaccggctgatcatccaccaaaacagcacgacgacataaaaaaggagccggcctgccggccgggctcctttttttatcctaatcgtttttcaagcgtttcaacaaactttgctaaataggcttcgtccgtttcatcaaaacggtttttcacagggctgtcaatgtccagcacaccgatcacttcaccgtttacgcggatcgggaggacgatttctgactgggaagccgcgtcacaggcgatatgtcccgggaacgcattcacatcggcaatccgctgcacggcgccgttagagtaggcagtgccgcatacgcctctgccgaacgggatgcgcacacaggcaggaagtccttgaaacggtccgagcacgagctcgccctctttagcgaagtaaaaccccgcccagttgacttcatgtaatgaatggtataaaagcgctgatgcattcgcgtaatttgcgatcgcatccgtttcatcttctgtcatggcttcgagctgtttaagcagaagctgataacttttttctttatctccggattgtttttcgacatgaaacatggaaaaccctcactttttctataatatcaaacaaagttccggccgttctgccggcatttgtcgagaagttcttacaggaacggcgcctttctgcttgaattgttacacataaaggggtgagccgtatgaaagtaagcaccaaagacaaaattattaacgccgctgtccagctgtttaaccaaaaaggttattccggcacgtccgtccgtgaaatcgcaaagtcagctgatgttaatgttgcgcacatctcctactattttaaagggaaaggcggattaatggaacatttagtttccgagttttacgaaggctatactgaagcgctggaaaaagccgccgtcagtttgaacggtgaagacgcgcaggaacgcatcctgcgggtgattttcgatattttatcctatcagcacgataaccgtcaactaacgcggtttgtgtaccgggaagtgacgattgattccgtgcttatcagggaaattatgtctacttacttaatgaaagaaaaatatattttccagctggtgattgaagaagggcagtcacgccacagacggctgacgctgcccgtgccgcattttattctgcaattgaaatccctcttgatgatgccgtatcttcagcctcaatacattacagaggtgctctatatgcagcctcatgaaccgtacttttataaaaggtattttgaagaggtgaagatctggatcgaaagcgtgttccgacggcctgatgcggcgcttatgaagtaatgatgcttttgtacgtttcataggaactgccgacatcttccgcttgatgggcgtccgacccgaatatgagcgggatttttttttgcttcgcggtctcagccatccaatcctccatgtatacttccccggcaaacttctttctgagcccggatgtattcacatccagctccattccgtgttctttcacggcgtcaagacagcgggccgcaagctctcttatttgaggtgacatgctgtaagggaaaaggcgtgcgaattttttgacgagcgtgatatggccgacccgttttggcttaaaggggccgagcggtgttacaatggaagaatacacagtttcatagtattgttcatatacggcttcaacgcttccgaagtgcgcggcgagctgctgaaaggcgtgctcgtcaaaatcgaggcagatataagacggaccggtcttcaaaaaatgaacggataaaatgccgtcatccagtgaggggccgtacgtgttcagaaacgccgcggtttcctcttcataccctgtgataaaatcagtttcgagcccggtcagaatgctgatttgtccatcgtattcctttttcagctgtgacagccgctccaaataaacctccatctgtctgagatccatcgcgctgtcctgaagcggtacgggatcttgaaatgacggaggaaggggggcgtgctctgtaaatgtgatcgagtcaaagcctctttccagggccttttcgacatattctttcagcgcatccttcgagccgtgagggcaaaaaggcgtgtggatatgagcgtctcgtttttccatttgtgtcactccattaaaaaattgcagaatcctgccgaaattatgcaaaaagtttttgatttctggtcaaaaaatgttggttacatggtatcataataacaatgaaaacgacagattttctcaatacatatattgaaatctttctgaatacataaaacaccctgacagattaagagaacaacaaggggctcattatggagttagtcatcggattattggttatactgctcgcgctctttgcggcgggctactttttcaggaaaaaaatttatacggaaattgaccggctggagtcatggaagattgaaattttaaaccgttcgatagtggaagaaatgtccaagatcaaacatctgaaaatgaccggagagacggaagagttctttgaaagatggcgcgaagagtgggatgaaattgtcacagcccatctgccgaaagtagaagagctcctttatgatgccgaagagaacgccgacaaataccggtttaaaaaagcgaatcaggtgcttgtccacatcgacgacctcctcactgcagccgaatcaaatatagaaggcatactgcgtgagatcagcgatcttgtgacgagcgaggaaaaaagccgcggagagattgaacaggtgcgtgagcggtattcaaaagcgcgaaaaaaccttctggcgtatagccatctctacggagagctatataacagcctggagacggatctcgacgaaatctggagcggcataaaaaagttcgaagaagagacggaaagcggcaattacatcaaagcgagaaaagtgctgcttgaacaggaccgcagactggatcagcttcaaacatacatagatgacgttccgaaactgctcgctgactgtaaacagaccgtgcctaaccaaattgccaagctgaaagacggctaccgggaaatgacggaaaaaggctacaaattggagcatattcaaatcgaaaaagagctggagacactcaccaatcaattgaaacgggccgaaagcgcgcttttggaagaattagatgtcgacgaagcgtccgccattcttcagctgattgatgaaaccattcaatcgatgtatgaacagctggaaggcgaagtggaagccggacagtccgtattaagcaaaatgcctgagctgatcatcgcgtatgagaagcttgaggaagaaaaagaccgcacaaaaaccgaaacggagctcgtcaaggaaagctatcagctgacggcgggagaaatcggcagacagcatgctttcgaaaaacagctggaaacgatcggccggctccttgagcaggcgagagaaaagcttgacggtgagcatgtcgcttactcgctgctgattgaagaagtcgaggccatcgaaaagcagatggaagaagctcagaaagaacatgccgaataccgtgaaaatctgcaggcgctcagaaaagaagaactgcaggcgcgggaaacgctgatgaatcttcggaaaaccatttctgacacggcccgaatgctgcaaaaaagcaacgtgccgggaattcctgaacaagtcaaggacaagctcgagacggcaaatcatcatatagaagagaccgtcagccaattggaagagctgccgttaaacatggaggaagccgccaaacatctgaccgaagctgaaaaggtggttgcggaagtcagcgaagaggcggaagaacttgtgattcaggtgaagctgattgagcggatcattcagtacggcaaccgtttccgaagccagaatcatattttatccgaacagctgaaagaagcggaacggctgttttacgcttacagctataatgaagcttatgagatggcggcagatgctgttgaaaaagcagctcccggcgccgtgaaaaaaattaaagctgatcaatctgcttcatagacgcacaagcaaaaactgcaccctgatggaaatcagaggtgcagtttttttgtttctcacggaatataaaaagcgcctatggctgatatacatcaaaccgcaggcgctgaatgttacgattttgctttatttaattcgatgggcgggctgataaaaaacgtgatgatgcagccgatgatcgctccggcaatgcccggaagcacccagccgattcccatgctgtaaagcggaagatttgcgtttaagaatgaatctaatgatccgagcggaatgccggctgccttcaaaccgtccaggatactgaacagccccgttccgatcaggcaggcgatatagacttcgcgtctttccttaaagattttatcaataaaggaaagtacgataatgacaatcgccagcgggtaaatggctgataaaataggaactgaaaatgcaataatctcagcaagtccgaaatttgaaatcgccagactgaacagcgtgacaatcgtaaccaccattttgtatgataaagcgggaatcaattttgaaaaatattcgccgcaagatgtgacaagcccgatgcttgtcgttaaacacgcaacggtgatggcggcaccgagaacaatgtttcccagtgaaccgaacaggtaatcagatgaagctgataaaatctttgcgccttcgccgagcggcccgacagcgtccgtgcttgtcgctcccaaataggccaaagataaataaatgaatgtcaaacccgccgctgcaatcagacccgctttaatacaagcggcggcgagcgctttacgctgggtgacgcccctgcttttaacagcgttgacgacaacgacgccgaagacgattgaggcgagcgcatccattgttttatagccttccaaaaatcctttgaacaccggcgttccggaatatgcctgatgtacggcgcccagcccgcccatcggagtgacgatggcttttacgacaatgattaaaataataccgaatttaatgggagtcaaaatctttccgactctgtccacgattttggacgggttaagagctaaataatacgtaatagaaaaaaagatcaacgtgaaaacaaataaagataatctttccggaatgccgcttaaaaacggaactgcaccgatttcatatgaaacggttccggttctcggaatcgcgaaaagcggcccgattgataaataaagcacaacggtgaaaatagtgccgaataccgggtgagccttatcggcaagtcctttcgcgtctttgcccgttaatgcgatggcgataatacctaaaagcggcagtcctacgccggtcagtaagaaaccgcccatcgctttccagacattatgccccgccgcttgcccaagctccggcggatatatcatatttcctgccccgaaaaaagtgcgaagagcatgaaaccgataataacggtatctttgacaggtagtgagtgtttcataaaagtcctcctaaatactatgttgaaatattctgtcaattaattgtcagataatataacaaaacgaacattacttattatatggcaatgtacagagaagtcaatactcgatttattgcgaatttctatttacttttgttatggtagcataaatatcatacgatgtaccgttttcataaaaggagtaaaaaaaatgatatatttagacaacagctcaacgaccgagccgtatgaagaggttttggaagtgtataaacagacgagcagccgttatttcggcaatccttcgtctctgcaccagttaggaactgagacggagcagctccttgaagcggccgctcagcaaataaaaagaaccttacgtttaaaaaattatgatattgtatttacatcaggcgcgactgaagcgaataacgctgcgttaaagggagcggcctgggcaaacatgagtaaaggaagacatatcattgcttcggcgattgagcatccttctgtgacggagacgcttgatcagctgacagagctgttcggctttgaagtcacatatcttccggccgatcaaaacggcttcgtttctttgaaagacgtcaaatcggctatcaggccggatacgataatcgtcagcgtcatgcatgtcaataacgaagtcggctccattcagcccgtaaaggaaatcggcgggtttttgaagcagcaccggaatattctgtttcatgttgatcatgtgcagggcattcataaagttcctctgtctatagaagaagcgggcattgacctttgcactgtttcagggcataagtttcacggcttaaaagggaccggagcgcttatcgtcaaaaaaggaacgcggctcattccgcttataacgggcggctcgcagcaaaaaggcgtccgggccggaacagaacatacggcaggcgccgtttcccttgcgaaagcgatcaatctttccgcgcgtgacatgaatgagcggctttcttccgtggaggctgccaagaatgcgctcatggaaaggctgagcggggcggacggggtcgtcatcaacactcccgccgaaaacagcgctccgcatatcattaatttttccgttccgggcgtgaaggccgaagtgctgctgcacatgcttgaggaaaaaggaatatatgtctccacaaccgcggcatgttcggcaagagagcataaaccgagccgtgttcttctgcaaatgaataaaggcgaacaggttgcatcaagcagcatcagagtcagcctgaacttcatgcatacggctgacatcacggagccgtttatggccgcgctggtgccggctgttcaaaaactaaaaaaaatgatgaggtagcatatgaattacgatcatattttaatccgttttggtgaaatatccacaaaaggaaaaaacagacgcagttttattgaaagattaaaacaaaatatccgcctggtattaaaggattataaaaaagtaaaatacttttcaaaccgggaccggatgtcaattacacttaatggagaaaacccggagggaatttgttccttattaaagaatatattcggcattcaaagtttcagtctcgcaattaaatgcgaaagcaagctggaagacattaaaaaaacggctttagccgcgatagaaggcgaatataaaccggggaatacgtttaaggtcgagaccaaacgggcttacaagcagtttgaattagatacgaatgcgatgaacgctgaaatcggcggccatattttgaaaaacacggatggattaaccgtcgatgtgaaaaatcccgatattccgcttcggattgaaatcagggaggaagcgacattcctgaccattcgtaacgaaaaaggcgccggaggccttcctgtcggttccgcgggtaaagcgatgctgatgctttccggcggttttgacagtccggtcgccggtttttacgcgatgaaacggggattatcagttgaagccgtacatttcttcagtccgccgtatacgagcgaacgggcaaagcagaaagtcatggatctcgcgggatgcctcgcgaagttcggcggcagtatgacgcttcatatcgtgccgtttacaaagacgcaggaactcatccaaaaacaaatcccggaaaactatacgatgacggcgacgcggcgtcttatgctgcaaatcgcggacagaatcagagaagaacgaaaagcgctcgcgatcattacgggggaaagcctcgggcaggtagcgagccagacgcttgaaagcatgtatgcgatcaatgccgtgacggcaacaccggttttgcgccctttaatcggaatggacaaaacagaaatcatcgagaaatcaaaagaaatcggcacttatgaaacaagcattcagccgtttgaggattgctgcaccatctttacgccgccaagtccgaaaacgcgtccgaaaaaagaaaaaatcgagcacttcgaaagcttcgttgattttgaaccgctgattgcagaggccgctgccggcatcgaaaccatcactgtttactcagagcaggaagctcacgataagtttgccggcctgttttaaaactgtatacaattaccaaagtttttttgaatgaagacatgtgttttatcacattctatactcacaaggaggtgatacacatgtcacaacaatcaaacagcggaaacagcaaccagcttttagtgccaggcgctgctcaagctatcgaccaaatgaagtatgaaatcgcttctgaattcggtgtaaaccttggaccggaaacaacttctcgcgccaacggttctgtcggtggagaaatcacaaaacgtcttgtctcttttgctcagcaaagcatgggcggaagcagccagcagcagttttaatcacaacttcacataatggctaagagagcggggaattccccgctcttttttcatgagtatagatagaaggctggaagcaatttatgcatatttttattgtaatggcctatgtttatgtataatggggaaagaaagtgaggagttgttcgtgttaaaacgagaagatttaatcgccccaaagaactataatcttgtaaatgaaatcgaaaagttcagccgttccaaagagaagaacgcgcttatttgggaagatcaaacaggcggcaagaaagtctggacgtatgaaaaattgatggaagaaacgaataaaatcggagcccgcctgaaaggtctcggatttgaaaaaggcgataagctgattgtcatggttccgagagtgcttgaagcgtatgccgtttatttagcgatcttaaaagcggggatggtcgtcattccttgctcggaaatgctgcgcgccaaagaccttgaataccggatcaaacacgccgaagtgaaaggcgctatcgtttatccttcatttataaacgcatttgacgaggtgaataccgagcagctggtgacattgtcaatcggtgaaaatgatgccggctggaaaaacctcttaacgattgaagcggacggaaacagttttcaaacagctgatacaacaagagaggacatggcgtttttgtcctatacttcaggcacgaccggccagcctaaaggcgttgtacatacacacggctgggcctttgcccatttaaaaacatcagccggtgcatggctggatatttccgaagacgatacagtgtgggccaccgcggcgcccggttggcagaaatgggtgtggagcccgctgctcgccgttctgggaagcggcgcgacaggattcatttatcacggcagattcaacgccaagacgtatttagagctgctggagcgccatcaagtaaatgtcttctgctgtaccccgacggaataccgcctgatggcaaaagtggaggagttggacaaatatgatctttctgcccttcacagcgcagtttctgcgggtgagccattaaaccgggaagtcattgacgtattccggaagcatttcggtattaaagtgagagacggatacggccaaacggagagcaccctgttagtcggcgtcctgaaggatatggatattaagccgggaagcatgggcaaaccgacccccggaaatcaagtagagattataaacgataagggcgaaatatgcgaaacaggcgaaacgggcgatatcgccgtgcatttgagcacaccggccttattcaaggaatattataaagatcccgaaagaacgaaaaagcagattcgcggagattattttcttacaggagaccgcgcgaaaaaagacgaggacggctacttttggtttgagagccgcaatgatgacattatcgtcagctccggatatacaatcggaccttttgaagtagaggacgcgctcgtgaagcatccggaagtgaaagaatgtgcagtcgtggcaagcccggatgaaatcagaggttcaatcgtaaaagcttatgtcgttttacaagacgatgaaaagcggagtgacgaacttgtcaaagaactgcaaaaccacgtaaaaacgattacggcgccttacaaatatccgagagagattgaatttgtcgaaagcctgccgaaaacggcgtccgcaaaaatcagacgtgtggaactgagacagcgtgaagaacggctgaaggctgataaaaaagcataatacaggataaagggtgagcggggatgaaagcgatttggcacggcggcaccatctatacaatgcttgacaagaatcatgtcactgaatccgtttataccgaagaaggcgtcgtcaggaagacgggcagctatcgggagctccaaggaacatacggttcgcctgatacggaggaaatcgatttacatggagctgtcatgttcccggggtttacggacagtcatatgcatttaatcggacacggggaaaaacagcttcgcctcgatttgtcgcagctgacgtcaaaagaagcgatcctgcgggccgcaaaagaagcagagcgtgaattggaagatggcgaatggctgatcggcgaaggctgggatgaaaacctgtttgaacggccggattacgtcacgaagcatgaccttgacccgctctttcccgaccgccccgtcctgctgaagcgggtatgccggcacgccgttgcggttaattcggccgcattgcgcgcggcggggattacaaacgaaacatctgatccaaacggcgggattatcgtccgggacggcaccggtccgacaggccttctgctggataaagcccaagagcttgtgacacaggccctgccgcccgtctcacttcactatgtcaaacgcgcgcttcaaacggcgattacggactgctggtcaaaaggcctgacaggcgggcattcagaagatctggcatactacggagacgcgtccgttcccgttgccgcgtacgagtctttaaccggcagcggcctttatccttttcgcgcccatctgctcgttcatcacgaagccgtcgacagctggagcgctctggataaatcgaccggaccttacctggaatacggagcgatgaaaatttttgctgacggcgcgctcggaggcagaaccgctctgttgaaaaagccttatcatgatgatccgtcagtttccggcgttcaggtgcacgatgacgagacccttgccgctcttgtttataaagcgagagagaaagggatggagatcgccgtgcacgcgattggcgaccttgcatttgaaaaggtgctcgatgttatcgaaagatacccggcaaagcccggacagctagacaggctcattcatgcgcaagtattagatgccggattgattgaaagagccgcccggctgccgatcggacttgatcttcagccgcattttgtggccagtgattttccgtgggtgattgaccggctcggagaagagcggatgaaaacggctttcgcctggaaaacactgctgtcaaaagggctgctgtgcgccggaggctcagacgccccgattgagccggccgatccgcttctgggcattcaatcggctgtgctccgtacaagcaagcagcatccggaaggtccggcctattatgaaaaagagtgcctgaccgtgtacgaagccattcagctttacacggagggaagcgcggccatcatccataaagaacatagccgcggacggatcgcccccggctatgatgccgactttaccgtactcagcggtgatccgttcgggacggatccgaaaaagcttcatgaattggaagctgtcaaaaccgtcgtcggcggccgtatcgtatatgaaaaagaggacaggcagtgatgcccgtcctctttttttatgataaaaatgatcgctttactttttcccagaaagagttgtctttcagtttcaccgttttgatttttttatcggatagtgtaatctcaacctttttgacattccgcgtgctgagcgcttcattatcaagcccgataatcggatgctcattgccgtcctggaccacctgcagtgtcagcttccggtctgagcttaaaataaacggagatccgagtgtacggtatgtgttgttgttcaacgacgccagttcggatacctgcatgcaggaaatcaaaggatcaacaacggcgcctgaaacagatttattgtaggcggtgctgcccgtcggggtggaaatgatcatcccgtctcctctgaacgtctcaaaatgaagatcatcaattaacacatccatcacaaacgttttaataatgcttgaacggatggaaacctcgtttaaacagtgaaaatgattgctgccgtccaccgttacatgaatgagcgggtattttctgacctcaagctgttccgcggtcatgctggccgccattttttcaggctcatcgctgtgaaaatcacagtacaaatgggctttcccttttttagcgatgccgacatacaggcagtcatcacggaatccggtttttctgacggcttgcagaaatgagccgtcgctgccgatgctggcgataattccggcatcctccgggtgagccgcaactgtaaaaccgtgcgattcagcaagctgcttcaaagagctgacttgttcttttgtttcgttgttttgtttgtgaaaaaaataaacattgcggcgaagatcggtcatatccccattcccctttgctgtcatatttacgtttttctcccagcaggtattgtgttaaaatacctgtggcaatagtgtaacatgtttcctgtttatccgttaagagaaagcgcttcatgaaaaaaatgaatctttttttacgggggaacgtacgaatattgacagaaaaggaggagaacaaatgaatgcaaaaagatggattgcgctcgtcatcgcgctcggcattttcggcgtatcggtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagatcatttttaaaacaggttgagcgtgcgaaagaagataaaagcgtcaaaggaattgtactgaaaatcaattccccgggcggaggcgtgtacgaaagcgcggaaatacataaaaaactggaagaactaaagaaagaaacgaagaaaccgatttatgtgtccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgatacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtaggggggaagaaagaatggacgcgacttacgaaggctttcacggcaaagaagaggaagccgaacaacagagggcgcccgagcaggcatatgcgggcttttggatcaggttttgggcgtttcttcttgattggctggtggtctggggacttaaccatctcatcgtttcaccgattttcacgctgatgaagctcccggcaacaagcggaatgtttacaatctcagcttattccgtcacaaccctgatcgtctacctcgcctattttgtgttcatgacgaaatggtttcatcagacactcggcaagatggtcttcgggttaaaggtcacttctttgacgcccggaaagccgctgacttggagcaccgtcattttcagagaagcggtggggcgttatatcgataaaatctggattctctatatcgtcattgcgtttacgcccaaaaagcagggcattcacgatctgatcgccgacacaacggtgattcacgaagcgctgtaccgcaaataaaagcagtaaacccggaataaacgtccgggtttattttttttggttttggcgataatgctgctaaggaagtgaagcctatgggatatgccgcagcagctgttattctcattctcattttggtctggctgctcatgaggatgaaaatccatctgactttcgaatatcttcacgataaagataacgacaaactgacgtttaaactctcggccttatacgggctggtccgttttaaaaaaacgctgcccgtcattaaagtaaacagcgaagacgcgtctattgatgtcaaacaggacacgaaatcagaaatgaaaggtcagaaaaaagagaagaaaaaaatcacatatgaagatgtcaaacagagcattcacagaatagaaatgattctgcaccaagtcttgcagatgcgccaaatcgccgcctcatttcttgcgggagtccgtgttacgaagtttgaatgggtgacggttatcggaataaaggacgccgccgttacgggaatcgccgccggcggattgtgggccgtaaagggaggccttacggcgatgctgtatgatcatctgcgtttcatacataaaccggtgtgcgaagtcattccgtcttttcaagtgcctgcatccaagacgcatttgcagtgtatattcttttttcgttttggacatcttataggtgcagctttcaaattgctcaaatacgggcggaacggactttctatcatacgaaagaaacagccggttccggttgcttcaaagaatgattcatcagtttaaggaggagcgcatatggcagaccaccccattcaaggtttaatgaaaaccgctatggaaaatttaaaagaaatgattgacgtgaatacaatcatcggcgatcctgttgaaacgcctgacggcagcgtaatcttaacggtttcaaaggtcggattcggatttgcggcgggcggaagcgagtttggaggaaagccggctgaaaaaagaaccgatgatgatgaaagaaaagagcagaaactcccgttcggcggcggaagcggcggcggagtatccattacgccgattgcgtttctgattgtcggaacaaacggcgtgcgtatgcttcatttagacgaaaacacccatctgattgataaactgttagactccgcgcctcaaacgattgaacgcatccagcatatgtttaaaaagaatgaaaaaggccggaaccaaaaaagaacggatatcgatttataacagaaaagttaactgccgcccgcagttagctttttttacgatgcggcataacctttgcagtttgcataaaactcgactatgatagagctatacatagataaagggaggaatcagaatggctgaaattacatttaaaggcggagccgtgacgctgatcggacaagaagtgaaaccgggtgaccaagctcctgacttcacggttttgacaaacggattagaagagaagacattagcagatatgaaagggaaagtaacgatcatatccgttattccttccattgacacaggcgtatgtgacgcgcagacacgccgcttcaacgaagaagccgcaaaactcggtgatgtgaacgtttatacaatcagcgccgaccttccgtttgcacaagcgcgctggtgcggagcgaacggaattgataaagtggaaacattatcggatcataaagagatgtcatttggtgaagcattcggtgtttacatcaaagaacttcgtcttttggcgcgttccgtattcgtccttgatcaggacggaaaagtcgtttacgcggaatacgtaagcgaagcgacaaaccacccgaattatgaaaagcctatcgaagctgcaaaagcgttaatcaagtaaagagagaaaaagagctccgggtgctgccgcggagctcttttcatggcaaggaggaaacagcatgcaacacgatcatgtcggtcagatttatgaacttttagatgaagccgcccaagtgatagcagaaggccttgagatttcttatattgaggggcttgcggaggcgggagagatgtattttcttgaaacaacggaccagcttccgcttcaggaaaaacaaaccggcgagcttaaaagcctgcttgcgaaagcagacttcagaaaatgggagcatgaatggatccgcaaggcgttccagctcgccattttaaaaggactgaaagataagtcccatccgaacagacagatgacgcctgatacgatcggccttttcatcagttacctcgtgaataaatttacgggcggccgaaaaggcctgacgttgctggaccccgcctgcggcaccggaaatcttctgctgaccgcggcaaaccagctttctgacaaagcgggaaaaagcttcggcattgaaatcgacgatgtccttctgaagatcgcatatgcgcaggcgaatctgcaggaaaaagaaatggagctgttctgccaggacagtcttcagccgttatttatcgaaccggccgatgcggttatctgcgatttgccggtcggctactatcccaatgacgaaggcgctgaagcgtttgagctgaaagcggatgaaggccactcatttgcccaccacttatttattgagcagagcgtcaaacatacaaaaccgggcggatacttattttttatgattccgaaccatctgtttgacagcgcgcaaagcgataaactgaagcggttttttgcggaaaaagtatatatcaacgccctgcttcagctgccggctactatgtttaaagatgaagcgcaggcaaagagcattttaatcctgcagaaaaaaggcgaagacgcaaagccgccgaaacaagcgcttttggcgaatcttccttcttttgcgaaccagcaggcgatgcgggagatgatggcaaaattggatcagtggattcaaaaagaaaaataatggcgaaaaagcagtgtgagacgcaaaattccgcgctgcttttcgctttttaaaatgaatggaaatcagggcgaaaacacaaattaaggaaagaaaataacattccgtaaggccgtgccgtccatttggcacaaatgagatttatcagaaaatatcgacttcgtattgtaagcggtaccaatgtggatgttgacttgaaatgctgagttgacaatgtttaaatggaaaagtcagatattttttggaccgcagttatggtctgggaaaaaagaacgaacaaacgaagaagaattttgataggagcgtcatttatgtctaaaattattgcaattaacgcaggaagctcatctttaaaatttcagttattcgaaatgccttcagaaaaggtgctaacaaaaggtttagtagaacggatcggtatcgccgacagcgttttcactatctctgttaacggcgaaaaaaatacagaagtgacagatattccggatcatgcggttgcggtgaagatgctgcttcacaagctgactgaattcggtattataaaggatttaaacgaaattgacggaatcggccaccgtgtggttcacggcggagaaaaattcagcgattctgttttgcttacggatgaaacaatccgtgagattgaagagatttcagaacttgcgccgcttcataacccggctaacatcgtcggcattaaagcctttaaagaagtgcttccggatgtgcctgcggttgcagtgtttgatacggcgttccaccaaacgatgcctgagcaatcttacctgtacagccttccgtacgaatactacgagaaatacggcatccgcaaatacggtttccacggcacttctcataaatacgtgacacagcgcgcagctgagcttctcggccgcccgcttgaagatttgcgtctgatttcctgccacctcggtaacggcgcaagtatcgcggccgtagaaggcggaaaatccattgatacgtcaatgggcttcacaccgcttgcgggtgttgcgatgggaacacgttcaggaaacatcgaccctgcattgatcccgtacattatggaaaaaacggatcagacggcagatgaagtattaaatacattaaataaaaagagcggactgcttggcatatccggtttctcaagcgacctccgcgatatcgtagaagcttcaaaagaaggaaacgaaagagcggaaacggctcttgaagtgtttgcgagcagaatccataaatacatcggttcttacgctgcgagaatgagcggcgttgacgcgattattttcactgcgggtatcggtgaaaacagcgttgaagtcagagaacgcgtgcttcgcggcttagaattcatgggtgtatattgggatcctgcgctgaacaacgtgcgcggcgaggaagcgtttatcagctaccctcactctcctgtcaaagtcatcatcattccgactgacgaagaggtcatgatcgcacgtgacgttgtccgtcttgcacagtaatgatcgaaaaaagcacatcctttagggtgtgcttttttattgaatgccccagaatcaaacgttacgatatgtttaatacataaacgatgaggtgaagcaatgagtgtgcatgaacataaacaagaagccccgtcagccgtgcgctgcaaggtgataacagtcagcgacacgagaacgaaagaaaccgacaaaagcgggcgcgtcatgatggatttcatcagagaagcgggatttgaaacggtcgcttatgacattgtaaaagatgaaaaagatgaattgcagaaagccgttttatccggctgtatggatgaatatacagatgcggtgctgttaaacggagggacgggcattgccgaaagggatgtcacaattgaagcggtcacgccgctgttttcaaaagaactcccggggttcggcgagctgttccgcatgctgagctatacggaggacatcggctccgccgccattttgtccagagcggcagcgggtgtgatccgaaataccgcagtcttctgcacgcccggctcctcaggcgccgtaaagcttgcaatgagtaaactgattattcctgaactgcctcatgtgctccgggaaatccgaaaagatttataaatgtataaaaaggctctgctccgctcaaaaaattgggtggggttttttttataaaaggcttgaaaaaacagaatttacttgttacagtgtatacatacaaaatgcatttttattaattaaaactaatttttatacaaagggagcttttaacatggcagaacaaaaaaaggttgtattggcatactcaggaggtcttgatacttctgtagcgataaaatggctgcaagaacagggatacgatgttgttgcctgctgcttagatgttggggaaggaaaggatttggcattcgttcagcaaaaagcgctggaagttggcgccgtaaattcctatgtgattgatgcgaaagaagaattcgcccgggagtacgcgctcatttctatgcaggcccatacaatgtatgaaggcaagtatccactcgtatctgcactatcccgtccgttaatcgcgaaaaaactcgtggaagtggcggaaaaggaaaacgcggtggccgtagcgcacggctgcacgggaaaaggaaacgatcaggttcgtttcgaagtatccattaaatcattaaatcctgatctggaggtcattgctccggtccgtgagtggcaatggtcgcgtgaagaagaaattgaatacgccgcaagccgcggcataccgattccgatcaatcttgacagcccgtattccatcgaccagaacctatggggacgcgccaatgaatgcggtatattagaagatccgtgggcggcgccgcctgaaggggcatatgacctgacagcatctcttgaaaacacgccggacgttccggaaatcatcgaaatcgcatttgaagccggtgttccggtttcaatcgacggcgtaacctacccgctcgctgatttaattctcaagctgaacgagactgccggaaaacacggcatcggccggattgaccatgtggaaaaccgcctggtcggcattaagtcccgtgaagtttatgagtgcccgggcgccatgactttgattacggctcacaaagagcttgaggatctgactttagtgaaagaagtggcccatttcaaaccggcaattgaacaaaaactgtctgaaatcatctataacggtttatggttctcgccgttaaaagacgcgctgcttgcattcctgaaagaaacccaaaagcatgtcaccggcgttgtgcgcgtcaagctgtttaaaggccatgccattgtagaaggacgtaagtcggaatattctctctacgacgaaaaacttgcgacatatacaaaagacgatgcgtttgaccatcacgcggcaatcggtttcattgagctttgggggctgccgacaaaagtaaacagcattgtgaaaaagaaggagcagattgaagcatgaagaagctttggggaggccgttttcaaaaaacaccggaaaagtgggtcgatgagttcggcgcatccatcacattcgaccaaaacttagtcaaagaggatattacagggtctctcgctcatgcggcaatgctgaaaaaatgcggcattctgacggaagaagaagaaggtgccatccgtcaagggctgcagactctcctgcaaaaagcagaggaaggagcgcttgaattctctgttgattatgaagatattcatttgaacattgaaaaaatgctgattgaagaaatcggaccgctaggcggcaaactccataccggaagaagccggaacgaccaggtggcgactgacatgcatctatatttgaaagatcatgtctcgcatatcatcgtgctgattgaacagttccaaaaagcgctgatcgaaaaagcggaggccaatgtcgagaccattctgccggggtacactcatttgcagcgggcccagccgatttctttcgcccaccatctgcttgcttatttttggatgcttgaacgggataaagagcgttttcgggatgctatgaagcggattaacatatcgccgctcggatgcggggcgcttgccggaactacgtttccgatagaccgtaactattcggcggagctgctcggttttgactccatttacgagaacagtcttgacggagtcagtgacagagattttattctcgagtttttaagcggcagcagcatgctgatgatgcacctttcacgtttgtcagaagaaatcattctatggtgctcgcaggaattcagattcattgaactggatgatacgtacgcgacgggaagcagcatgatgccgcagaagaaaaaccccgacatggcggagctgatccgcggtaaaaccggacgcgtatacggtgatatgatgggtcttttcacaattatgaaaggactcccgctcgcttacaacaaagacctgcaggaggataaagaaggcatgtttgacacagtaaaaaccgttgaaggaagccttcagattttcacgggcatgattgaaacgatgaaagtaaacaaagacatcatgaaacaagcgacaaaacaagatttttcaaacgcgacggaacttgccgattatttagctaaaaaaggcatgccgttcagagaagcgcatgaagtggtcggcaagcttgtgtacagctgtattgaaaaaggaatctatttaagtgacatggcatttgaagaattccttcaagccagcagtctctttgaagaagatatctataccgtgctcgatccgcatcatgcggttgaaaaaagaatgagcgccggcggaacgggttttcagcaggtagaacaggcgctcgtaaaagcaaaagcctgcgccggcatttaatttgctgaaatttccttcatattttcccgtcatatcagacaccctacatctataaaagatgggaggtaaaaggaatgcgcaaagaacaagaccgttacatctatgatgaaaaagaaagtgaagaaacggccaggcttatctcagaggcataccaaagcggttatgtcggcatggaggaagcctctgctccttcagaaaattaagctgtctgtaaagacggcttttttttcgtgcggacgaagtgcaaaaaagtgatattgccgtttgtttatagtaaagtagagggagaaacgtcttgattttattgaagcggctacgttgcctggggagggtattcaatgtgcgacatgctctaatcactgccggtacaaagggattgggccgaaaagtgactgaaatgcttctggaaaaaggcttttctgtcacagtgaattacagacaggacgaagaagcggtcgcttgtctgaaggcggattatcccgggtgccatgacagattgcaattcgttaagggcgatgtaacccggaaagaagatctcatgcggatcgccgatgcagcccttcagcggtttggaaggattgacatactgattaacaatgccgggccgtacatatttgagcgcaaaaagcttgccgattactccgatgacgaatggtatggcatgcttgaagggaatttaagcgccgttttccatctgtttaaagcggttatcccggtcatgagacagcagcgcttcggccggattattacatacggttttcaaggagcggaccatgcccccggctggcttcaccgttccgctttcggagcggctaaagtcggattggcttcgttaacgaaaaccattgcgattgaagaagccgaatcaggcattacagccaatatggtctgcccgggtgatattgtaggagatatgaaagaagcgtctatagaggaagcaagacggaaaatcggcaaagaaaagacgccgatcggcaggtccggaaccggagaggatattgcgagaatcatcgcgtttttatgtgaagaagattccgatcttgtaaccggaacggtcattgaagcaacaggcgggctgaatgtgattaacaggcatcaatccctgtaagttttttcgtttgtcaaaaagggaacttgataaatattaattttttatgaggtgaaaacgatgaaagtgacttatcacggacattctgtcattcaagtggaaacgaaaacccataacattatttttgatccgtttctgaccggaaacagtctgacaaatttgaaaccggaagaagtgaaagcggatgtcatcctgcttactcacggacacaatgaccatgtcggagatacagagcagatcgccaaacaaaacgatgcgctcgtcattgcgccgaacgagctggccgtttatctcggctttaaaggtttaaaggtccacccgatgcatatcggcggggcgcaccaatttgatttcggcaaagtaaaactgacacaggcgttccacggatcggcggtcactgatgaagaaaacaaaaccatcacatacaccgggatgccggccgggattttattaacgattgacggcaaaacgattttccacgccggcgatacggcgctgttctcagatatgaaactgatcggggaactgaatcacattgacctggcgtttctgccgatcggtgataacttcaccatggggcctgaagatgcgaaactcgcggctgaatggctgagagcgaaacaggtcgttcccgttcattacaatacattccccgtcattgaacaggaccctgacgctttcgctgaaagtctgcccggaggcgtcggcaaagtcatggcggtcggcgagaccattgagcttgcctgacatatgtgtcaaagaccttctgaatcaagcattcagaaggtcttttttgtggtgccgccttttttcgggcgtctcattgcgaatgaatcccccgtacccttataataaaagcagaagactgtccttagaggtgaaacgcttggcaacaaagcatgaacaaatcctatcatacatagattcgcttcctgtcggtgaaaaaatttcggtcagaagaattgcgaaagaaatgaaagtcagtgaaggaacggcttacagagccattaaggaagccgaaaacaaaggattcgtttccactattgaacgtgtgggaccatccggattgaacagaagaaaaaagaaaatattgaaaagctgacatacgctgaggtcgtcaatgtgatcgacggccaggtgctcggcggaaaagcaggtctgcataaaacgttgaataagtttgtgatcggggcgatggagcttgacgcgatgatgcgttatacggcggcggggaacctgttaatcgtcgggaaccgaatcaacgcccaccgccaggcgcttgaagcgggcgcggccgttttggtaacaggagggtttaataccgacgacagcattatcgagctggccgatatgcttgagcttccgattctctccacgagctacgatacctttacggtagccgcgatgatcaaccgggcgatctatgatcagctcataaaaaaagagattgtgctcgtggaagatattttgacgcccgcagatcggacagtgacgctgttccctaaggataaactggagaaatggtacgaaaagaactatgaaaccggacacggccgctttccggttatcgatcagcagatgaaaatccacggaatcctcacgccgaaagatatcgcggggcatgaccggtcagttcccattgaaaaagtaatgaccaaaaaccctgtcacggtgatcggaaaaacatctgtcgcctcagcggctcaaatgatggtttgggaaggaattgaagtgcttccggtgacagacgggcatcacaaactgatcggaatgatcagccgccaggatgtcttaaaagcgcttcaaatggttcaaaagcagcctcaggtcggggaaaagctggatgatattgtttcaaggggatttaaagaagaggaagataacaaaacgccggccgtttatcaatatgaagtcacgccgcaaatgaccaatcagctcggcacgatttcttacggggtgtttacaacgattttaacccaggccgccagccgatttttacgctcccgcaaacgcggcgagctggtcattgaaagcattacgattttcttcctgaagcccgtacagatggagtcggtcatagaagtgaaaccgcgcattttagaggcgggccggaaattcgggaaaatggaagtggaagtgtcaagccaaagcggcatcgtttcaaaagcgatgctcatggtgcagctgatggagagaagttaagggacacacccgggtcccttggcattcattatgcgtggtccctctccgcttcctttgcatggatgggctcataatgcttataggctttatacccggcccatgcgctgcctgctccgattaaaatgaagacgccgccgatgaccagggtcaggacggagtggaacagaatcatttggtttactccgtacaaaagcaccagcgcgcctaatgccatacttgatttagccgaaaaacattccttctccagcgcccgtttcgtctggattccttttactttgtaatacacgtaaaagcaggcagaaagcccgatgagaaaaacaaaaaccagcataaatgaaatcctccattatatgagtttgcaaaaccgtttataccgttgctgaaagattttccttttccatggataaagagtatgattaaatgaataaaaacgaaaaggagaaaacgatgaaatccgaactgatcagaaccatatcattatatgacaccattatcttacatagacatgtgaggcctgacccggatgcctacggttcacagtgcggccttacagaaatcctgcgggaaacgtatcccgaaaaaaatatttttgccgtcggacagcctgaaccgtccttgtcttttttatattccctcgatgaggtggatgacgaaacctataaagatgctcttgtcatcgtgtgcgacaccgcaaaccaaggcagggtcgacgatcagcgctaccattccggcgcaaagctcatgaaaatagaccaccatccaaatgaagatccgtatggcgatctgttatgggtcgatacgaatgcaagctccgtaagcgaaatgatctatgagctgtacctggaaggaaagcagcacggctggaaactgaatacgaaagcagctgagctgatctacgctggtatcgtcggtgatacggggcgcttcttattcccgaacaccacaaaaaagacattaaaatacgcgggagagctcattgagttcccattttcatcgtcagagctgttcaatcaattgtatgaaacaaaattaaatgtggtgaagcttaacggctttatttatcaaaatgtgtcactgtctgaaaacggcgtcgcttccgttttcattaaaaaagacattttggagacatatggaaccaccgcttctgaagcgtcgcagcttgtcggaacactcggaaatatttcgggtatccgcgcttgggtgtttttcgtagaagaagacgatcaaatcagagtccggttccgttcaaaaggtccggtcatcaacggaattgcccggaaatacaatggcggcggacatccgcttgcggccggcgcatccatcttcagctgggatgaaaccgatcagattcttgctgatctggaagaggtatgtaacgaacacaagtagaggggagaccctctttcttagtgttcatctgtcacggggatgaaccagcagccgaattcagtcaggtcttcgtagacgcggagattacagatttggagttctttttttatgagggaagcgagtgtgtctgtttctgcatatgcggaatagccttgtctgattcgggctgcatgatcttttgccaagcggcgttcactaaaaacctccattttcccttcctcccttcagaatcgttgaaaatgtctcatctacagtttataaaaaagcggagaaaaaagcgacagatctatggaaaatttttaaaaataacataattacgtcgcaaaagaaatatgaatttcgacagacaatctcgtataaatcgtcagttcctttacttcagctttaaattccttctcatttatggtgtatattttgttttcaattgtccgttttaaaagctcctttgttttatacacgctttcaatatcctttgtgatgacttcagaaatattatctttcacctgttcctcaaatttcatcttgtcaggctgggcgattctgtatttttcccaattaatcagcttcacatcaacactttggatgagaagtctttgcttattatcctcatttaatttatgaagatctttctgatagatggagatttggttttttaaatcccgcgcgtgctcccgctgcttttcaattaacgtcacctgttcttcctgaaacgttccgtatgtaaacagaaagaacagccagctgatgatggctccgcacatcattcccgcaaaaaaacgctgccatcccggttttttataatactcgggaattctcatgatgacatattctcctgggtcagccatgaaataatcagccagccggtctgcgcgccgcccattgctgaaataattaaaagaagctgtttgaagatgtcgcgcgtgttgccttcaaacagcccccgctcgaaactgtataccgcgtcaaatgttcccccgatggccgcgacaagcgcccagatcttcagcctgttcgccaattttgtgatcgccgtcagcggaggctcgcctgataaataagctccgaggccgccgatcagcgcgccgccgagcaacacaccgagggcgataaaataactgctgatgaaattcgccataaagccggcttcctgatccatatatacaccacctcacttttctatcatattgagcgaaacggacaagtatgatgatgagtcaaaaaagaacatttgtttcttaagaaaacccgtcttataatgtagaaagacaaaatgaacgtatgggaaaggagtggcggcattgtcttttgttcacctgcaagtacatagcggctacagcctgttaaacagcgccgcttctgtaaaagagcttgttacacaagcgaaggaactcggatattcatcattggcgctgacggacgaaaatgtgatgtacggcgccattgagttttataaagcatgcaaatcaaacggaattaagccgattatcggtctgacggcttctatatacacggacgatacggagcttgaagcacacccgctcattcttttagcggagacaaacaccggttatcagaacctggtgaaaatctcaagtgcgctgcaatccatggcaaagggcggcatgaagcgaaaatggatgaagagctatcatgaggggctgatcgccattacgcccggtgaaaacgggtacattgaaagcctgcttcaagccgggaagtttgaagaagcggtccgggctgccgaaggattccgggagctgttcggagacggccgtttttatttagggtaccagccgtttaaaggacatgagacgttatcagaagagattctccgcctgtcagccgagacggaaatcgctgtctgcgctgcgggagatgtccgctatatcaagaaagaagatcaagatgcgtaccgctgtctgtgcgctattaaagccggagagaaatgggaggatcagagcgggaatctgccggacttatacttgaggacgcctgaagaaatggcagagctttacacgcggcatccggaagcgattgaagcggccgcccgtatcgcccggcaatgccgggtcgatgtaagcctcggacagacacagcttccgtcttttccggcgccggacggcaaatcagccgatgactatttggcggagatctgtcatgaggggctgcgtctccgtttcggcactcctgatgagcgggctgtccgccggcttgaatatgagctggacgtcatcaggcgcatgaaattcagtgattattttctcatcgtatgggactttatgaagtacgcgcatgaaaagggcattgtgacaggcccgggaagggggtccgcggcaggctcgcttgtcgcttactcgcttttcattaccgacgtggatccgcttaaacattctctgctgtttgagagatttcttaatcccgagcggatcagcatgccggatattgatatcgatttccctgatacgagaagggatgaggtcattcagtatgtacaaaataagtacggggccatgcacgtcgcccagattatcaccttcgggacattggccgcaaaggcggcgttaagggataccgggagagtgttcggaatcagcccgaaagaagccgaccagcttgcccgcctgatcccgtcgaaaccgggaatgacgcttgaggaggcgaggcggcagtccgctcagctgaacaggcggctgtccgaatccgccgttcttcataaagtgtttcagatcgcaaggaaaatcgaaggtcttccgagacacacgtcaacacacgcggccggggtcgttctcagtaaagagccgctttcggaagttgtccctcttcaagaagggcatgacggcgtgtatttaacgcagtatgcgatggatcacctggaagatctcggtcttttgaaaatggactttttaggtttgcgcaacctgacgcttattgaatccattaaaacgatgattgaaaaagagacgaatacgaaaattgatttttccgagatttcttatcaggatgaaaaaacgttctcgctattgtcaaacggtgatacgacgggtattttccagctggaatcatcaggaatgagaaacgtgctgaagcgcctgaagccgtcaagactggaagacattgtcgcggttaacgcgctttacaggccgggaccgatggaaaatattccgttatttatcgatcggaagcacggacgggcgcgtgtggaagtgccgcacgaggacgtaagaaatattctcagtgacacttacggcgtcatcgtctatcaagaacagataatgatgatcgcctcgcgcatggcagggttttcattaggtgaagcggatctgctcagacgggctgtcagcaaaaagcaaaaggacattctggacagagagcgaagccattttgttgaagggtgcttaaaaaaggagtattctgtagtcactgcaaacgaggtctacgatctgattgtaaaattcgctaactacggattcaacagaagccatgctgtcgcatacagcatgatcggctatcagctcgcctatttaaaggcgcattatccgctatattttatgtgcgggctgttgacgagcgtcatcggcaatgaggacaaaatatcgcaatatctgcatgaagcgaaggggagcgggattcaagtccttccgccgtcaataaacaaaagcggttttccgtttgcgccggaaaacggagccgtcagatacagtttgcgggccgttaaaaacgtaggcgtctcggcagtgaaagatatttataaagcaagaacacataaaccgttcgaggatcttttcgatttctgctttcgcgtacctgcaaaaagcgtgaatcggaaaaccatcgaagcccttatattttctggcgccatggacgaattcaatcaaaatcgcgccgccttgctggcctccgttgatgtggctttagagcacgctgaactttttcgtgcagacgatgaccaaatgggattgtttttggaagaatcgttttccattaagccaaaatatgtagaggctgaggaatttccgctcgtggacaagcttcggttcgaaaaagaagctctcggtgtttatttctcaagccatcctttgtctgctttcagggatctcctgaaaaaacggggggcgcaaacgatcacagcagcgcggcagatgccgaagggacagctgtcaatcggcgctttgctcgcgggcattaaaacgattcggacaaagacaggtcagcatatggcgtttctcacattaagcgatgaaacgggagaaatggaagccgtcgtgtttcctgaccaatatagaaggctgtctccgctgttaaaagaaggcgcgcttttattcgccgccggaaaaatggaagagcgtcaggagaagacacaattcatcatgtcatccgcctctcttcttgaacagacggaggcagacagagcgccgtctgtttacatcaaaatcgaaggcagccggcacaatcaggagtttttggaaaagatgaagcgtattttactggagcataaaggggaaaccggcgtttatctatattatgaaaaagacaagcagacgatcaggctgccggatacttttcatattgaggcggaccatcaggcgttataccgtttaaaagagctgctgggccgcgaaaacgtcgtgttaaaatagtggtaacaataatcgttttgttatacaattgaaacaattgtgctatcttatttaaagattctgaaatttttcacctccagcgattgtaccagtctatgcggcagaatatgtaacaaagtacttaaaaggagtgtttagaatgtcattaagagaagaagcgttacatttacacaaagtaaatcaaggaaagctggaatcaaaagcaaaggtagaagtcagaaacgcggacgacttaagccttgcctactctcccggagtagctgagccttgtaaagagatttatgacgataaaaataaagtatatgattatacaatgaaggggaacatggtagcagtcgtaacagacggatcagccgttctcggtctcggtaatatcgggcctgaagcttcacttccggtcatggaagggaaagcggtgctgtttaaaagtttcgcgggcgtggatgcattcccgatcgcgcttgacacaaacgatgtggacaaaatcattgacactgtgaagctgcttgaaccgacattcggaggtgtcaaccttgaagatattgcggcgccgaactgcttcattatcgaagagcgcctgaaaaaagaaacaaacattccggttttccacgatgatcagcacggcactgccatcgtaaccgttgccggacttgtaaacgcgctgaaattatcaggaaaatccatgtcatccattaaagttgtggcaaacggagcgggagcggcaggcatcgcgatcattaagcttctttaccatttcggcgtacgcgacatcgtgatgtgcgactctaaaggagcgatttacgaagggcgtccggccggcatgaacgcggtgaaaaacgaagtggccaagtttacaaaccaagaccgcaacgatggctcgctgcaggatgtcattaaagatgcagacgtctttatcggcgtatcagtcgaaggcgcgctgacgaaagaaatggtggagagcatggcgaaagatccgattatcttcgcaatggccaacccgaatccggaaatcatgcctgaagacgcgcgcgcagccggcgctagcgtaatcggaacaggccgttctgatttcccgaaccaggttaacaacgtgctggcattccctggaattttccgcggggcgcttgacgttcgcgcgactcacatcaacgaagaaatgaaaattgctgcggttgaagcgattgcttcccttgtttcagaggaagaattaagcgctgattatgtcatcccggctccgtttgacaaacgcgtggctcctgccgttgcgaaagctgttgcgaaagcagcgatggaaacgggcgtcgccagaattacggtcgatcctgaagaagtggctgaaaaaacaagacagctcacagtcatcggggaataataacacaaaaatgaaatggcagcgcgttggaaaaaacaacgcgctgctgttcaatatacggactgctggcatttttttaagggcaggtcttaaaaaaatttcagcagaatccttatttcttttgaaaacgctgacagataaggctgaacaacgctttttacggtatgaaatccgtccgtttccgtctgttttgcagcaaaaaatgtcgaatggaggatgacaccgtttgacaaaaaaagtacaatagtttcggtaaagttattattaagtctatctaatcggaagacatgcagtgaagagaacccttcacaaaagggaggtaatcatttgttaaaggatatattcacaaaaaagaaaaaatatgcttccgtgccgtctgagcaggcaaaacatgatgttccggaaggcattatgacaaagtgccccaaatgtaaaaaaatcatgctcacaaaagagttagataaaaacctgcgcgtctgcatgaactgcgggcaccatttcccgatgaatgcaaagcagcgcattgaaagcctcctggatgaagattcattcgaagaattcaaccagggaatgatatctgaaaacccgctcggtttcccggaatacttagaaaaaatcgaaaaagaccgtgagaaaacatcgctgaatgaagcggtggttaccggaaaaggaaccatcagcggattccctgccgtgatcgcgatcatggattcaacattccgaatgggcagcatgggttcggttgtcggcgaaaaaatcacgcttgcaattgaaaaagcaaaagaggaaaaagtcccgtttatcatctttaccgcttccggcggcgcacgtatgcaggaaggggtcttaagtcttatgcaaatggcaaagacaagctctgcattaaaactgttcagtgaggagcagggactgattatttctgtcatgacccacccgacgacaggcggcgtatcggccagtttcgcgtctctcggtgattataatttcgctgaaccgggcgccttgatcggatttgcaggaagacgtattattgaacagacgatcggggaaaaactgccggaagatttccagacggcggaatttttattaaagcacggccagcttgatgcggtgattcaccgaaacgacatgaaagagaaactcgcatttctgctggacatgcaccaaacaggaggtgagcatgagtggctgcaagattagaatttgaaaaaccggtgattgaactgcagacgaaaattgccgaactgaaaaaattcacccaagattcggagatggatttaagcgctgaaatcgcaaggcttgaagaccggctcagcaagctccaggatgagatttataaaaatctgaagccgtgggacagagtgcagatcgcacgccttcccgaccggccgacgacgcttgattacattcaatacctgtttaccgacttttttgagtgtcacggagacagaacatacggagatgatgctgcgattgtcggcggagtcgccaaatatcacggcatgccggtcaccgtcatcggacatcagcgcggaaaagacacgaaagaaaaccttgtccgcaatttcgggatgcctcaccctgagggctaccgcaaagcgcttcgtctcatgaagcaggcggataagttcaaccgcccgattatctgcttcatcgacacgaaaggagcgtacccgggtaaagcggcggaggaacggggacaaagtgaagccatcgccaagaacctgttcgagatggccggcctgacagtgcctgtcgtttgtatcgtcatcggggaaggcggcagcggaggcgcgcttgcgttaggtgtgggcaaccgcatgctgatgcttgagaactcgacgtattccgttatttctcctgaaggagccgcgtccattttgtggaaagactccagccttgcgaaaaaagcggccgaaaccatgaagattactgcgcccgatttattagaattaggaattattgatgatatgattaaagaagtgaagggcggagctcaccatgatatcaagcagcaggcgggctacattgacggtattcttaaagaaacgttaaaatctcttcttcgattgaacgccgaagagttgatctcacagcgctatgaaaaatataaagcaatcgggaaagtttcggttgaggatcaatatatcggggtaaactgaatagacgtgaagcctatggctcacgtttattttttgtgatttttgtgatattccttaaattttatttaaaaacaatttatttaattgtataataggtaaggtttcatgggagctcaggcgtcccttttcattgttttagggcaatgatcatgatatgtttaacatatatagttgctgaggtgaataggaaatgaagcgtataggagttttaacgagcggcggggattccccgggtatgaacgctgcggtgcgcgcggttgtgcggaaagctatctaccacgacgtcgaagtgtacggaatttataacggttattcaggattaatcagcggaaaaatagaaaaactggagctgggttcggtcggtgacatcatccaccgcggcggaacaaagctgtatacggccagatgtcctgaattcaaaacagttgaaggccgtgaaaaaggaatcgaaaatttaaagaaactcggcattgaaggtcttgtcgtcatcggcggagacggttcatacatgggtgcgaaaaaattaacggaacacgggtttccgtgtgtaggtgtaccgggtacgatagataatgacatcccgggaactgattttacgatcggatttgatacggcgttaaacaccgtaattgatgcgattgataaaatccgtgacaccgctacgtctcatgagcgtacatacgttattgaagtgatggggcgccatgcgggcgacattgctttatgggcaggtcttgcaggcggagcggaatcaatcttaattcctgaagcggactacgatatggaggaaattatcggccgtttgaagagagggcacgaccgcggcaaaaaacacagtatcatcatcgttgcagaaggggtaggcagcggggttgaattcggaaaacgcatcgaagaagaaacgaaccttgaaacacgggtatccgttttagggcacatccagcgcggcggatctccaagcgcttctgaccgggttcttgcaagccgcctcggcgcttacgcggttgagcttctgcttaaaggaaaaggcggacgctgcgtaggtatacaaaacaacaagcttgtagaccatgatattatagaaattttagaatcaaaacatactgttgaaccaaacatgtatcagctttcaaaagaactgtctatttaaggcggaagaagctgaagatttcagaaggaagtgaacgagttgaaaaaaacaaaaatcgtttgtacaatcggtccggccagtgaaagtgtagaaatgctgacaaaattgatggaagcgggtatgaacgttgctcgtctgaatttttcacacggtgatttcgaagagcacggcgcaagaatcaaaaacatcagagaagccagcaaaaagctcggcaaaaacgtggggattctcctcgatacgaaaggtccggaaatccgcacgcacgatatggaaaacggcgcgcttgagcttcaggcgggaaatgaaattatcgtttctacgaaacaggtgctgggaacgcttgaaaaattctcagtttcttatgaaggcctggcagacgacgtgtcagcagggtctatcatcctgctggatgacggtttaatcggattggaagtgctggaatcaaatccggaaaaacacgaaatcaaaacaaaaatcttaaacagcggcacgctgaaaaataaaaaaggcgtaaacgttcccggcgtcagcgtcaaccttcccggaattactgaaaaagacgccaaagacatcatattcggtatcgagcaaggcgttgatttcatcgctgcgtcatttgtacgccgttctacggatgtcctggaaatccgcgaactgcttgaagagcataacgcgtctgacattcaaatcattcctaagatcgagaaccaggaaggcgtggacaacctggatgcgatcctggaagtatctgacggcctaatggtagcgcgcggagacctcggcgtagagattccggccgaagaagtgccgctcgtgcaaaaagaaatgatcaaaaaatgcaacgcgctgggcaaaccggttattactgcgacacaaatgctagacagcatgcagcgcaaccctcgtccgacacgtgctgaagcaagtgacgttgccaacgccattttcgacggcacagatgcgatcatgctttccggtgagacggctgcgggacaatatcctgttgaggcggttcaaacaatgtttaacatcgccacacgcacggaagaatctctgaactataaagaaattctgtctaaacgcagagatcaggtcggcatgacgattactgatgcgatcggccaatcagttgcgcacacggcgatcaatctgagtgcggcagctatcgtgacgcctacagaaagcggccatacggcgcgtatgatcgcgaaataccgtccgcaggctccgattgtagccgttacggttaatgagtctgtatcacgcaaactcggccttgtattcggtgtattcccgtcaagcggccaaaacgcgaattctacagatgaaatgcttgaagacgcggttcaaaaatcacttgacagcggcatcgtgaaacgcggtgatctgattgtcattacagcaggttctgtcggtgaatcaggcacgacgaatctgatgaaagtccacactgtcggcagcattatcgcgaaagggcaaggcatcggacgcaaatctgcattcggtccggtcgttgttgcaaaaaatgcgaaagaagctgaacaaaaaatgacagacggcgcagtattggttgcttcaagcactgaccgcgacatgatcgcttcacttgaaaaagcatcagcgctcatcactgaagaaggcggtctgacaagccatgcagccgttgtcggtttaagcttgggcattccggttatcgtcggccttgagaacgcaacttcagttttaacagaaggacaggttatcacagttgacgctgcccgcggcgctgtgtatgaaggccgcgcaagcgttctttaaacagctttaaaaaagagaggggggttctcccttctcttttgtctttaggttgattttcctattcccatgcgggcggtgacgcgcttttagaagggcaggagggcagaaaaatgagagtgttattcttactgtttatcgtatgtccggcaattgaaatcggtttgtttctgctggcgggaaaatggctcggtatttttccgaccttccttctcatcattttgacaggcgtgttaggcgctttggtggcaaaaagacagggaaccgatgtgtatcatcgggtgatgcgcgacctgcagcacggcaaaatgccgggggaagcgcttcttgacggaatatgcgtctttttcggaggcctgcttttgatgcttccgggttttctgtccgatattgcaggggcctgtcttctgattccgttcactcggaaccgcatgaagccgtttttgttcaaatggctgagagggatgtcaaaaaacaagcggatcattatcaaataaaaaacggcagccttcttacagggctgctgtttttatttggattgaacagtaatataggcccatatttcttttagagcgcccgttgtgataaaggcctgaatgaaaacgagcagcgcgggcccggcagccagtcctaaaattccgaacaatttaaagccggcaaacagggcgattaaggtcgcaagcggatcaagtccgattgacttgcttaaaattttcggctccgtcagctggcgctgaatgagaaccacaatatataaaacaccgagaccgatcgcttgaggaagctgaccggcaatggccaaatacataatccagggaacaaagaccgacccggcgccgagatacgggagcagatcaaccaggccgataaaaaaggcgatggttgccgcatgctcaatccctaaaagaaaaagtccgataaagacaatgatcatcgtgaaaagtatgagcacggcctgcgccttaatgaaacctgccatcgcttttttcagctctcccgatacggccttggcgtttgccgaaacccgttccggaaaaatggaataaagcagcgccttcagcttatgccagtcctttgtcataaaaaaagtcgccagcattgcgaaaatgaagacggcagctgtattgggaaggaaggcaatccatttcggcaccagctccaaaagatgtgaaagcatgagccccgcatttttagcggctgtatcaccgagggtctgaatatgcgtcacgatggaagcctgctgattggtttccagcccgttaaataggacggtcagctcgtggtacaatggctgaatgcgggaagtgaacagctcttcgcaatacgtcataaaggcgctgatatggggagggagcgttttggccagataggcggttcccgaaatgatttccgcaacgagaaatgttgccgcgccgagaagaataagcaaaaagaagaccaggacaatgactgtattgactgaccggggcagccccgtcagtttgtccagccagtcaacaacgggaatgatcgctgatgacagaataagggcgatcagaaacggataagttaacggaaatgaggcgtaaccggccgctaaagcgccgccggccgcagcgagtacaaacagcgcgcggaaaaaaacagttgcatagtgcggattcacatcgatcctcctctcggtcggcacgtcctattacattagtttattcgtcaaaaaaaaggatatgattacagatatgatgaaagagggtgctttcaggatgtttacacaggcgaatttatttttactattattgctggccatcgcattggtagccaaaaatcagtcattgctttttgccgtcggctttctcattgtgataaaagctgtcggtcttgatcagaaactatttccggttattcagtcaaaaggcatcaactggggggtcaccgtcattacaatcgccgttttagtgccgattgccacaggtgatatcggttttaaacagctcggagaagcgatgaaatcatattatgcgtggatcgctctcggtgccgggatcgcggttgccttaatcgccaaaaacggtctcaccttattggaaaacgaccctcatattacaacggcgctggtcatcggcacgatacttgccgtcgcgcttttcggaggcgtcgccgtcggcccgttaatcggcgccggaatcgcctacttggccatgcaaatcgttaaaatattcacttcataaagtaaaaaagcggcgtaaagctgcttttttttgcgggtgaaaataagagtttgcagggcattttgtagttcagacaaatgccatttgcattattccgaggaatgaagtggcttaccatgtaacaaagaacttcggaatcgccggcgcatattgtgcgatgacagcggatgcagtaaggcggttccaattgatgaatggattaaaagctgatggaatttatgcacttgaaccaaatcaaaacttgaagtgttgttaaaataagcggagaccctttccttcaatttgaaagtttgttaaatttataatgagaatgaaaaaacacaattcggttggtagtccggatgcattatttaaaatgtcagtaaccttcccctcctcgggatgtccatcattcttcagtaaatttaggaggagggaatcgttatgaaattaacggtttactacgatggtcagttttgggtaggagtcattgaagttgtgaatgatgggaaattaagagcagttcgtcatttgtttggaaaagagcccaaggattcagaaatcatgcattttgttcataatcaacttttacagactctctcccgcactgaacaaacaggggtttgtgttaaagcaaaatctaagaagttaaacccaaaaagattacaacggcaagcttctaaagagatgaaaaatatcgggatatcaactaaggcgcaaaaagcgataaaacaggagcttgaagcaagaaaagaaaagaaaaaacaactgaacagaaaacaaagagaaaaaataaaggaacaaaaatatttaatcagaaaacaaaaagcaaaagaaaagcataggggcaaatagttggagaacccgaagcccttcgattaaaaagttgagcggcatcagttttttcttcggactgatttagaaaaaagaagcagaaatcgagcccttctcgagatgaggagggtttttctgcatttatttaacttcacctacatcagtaaatgagtcagtttcaattgatgaacggtttgatgaggatatttacgggccgacaacagcgcaaatgcagtcaaacgattccagtccatgtacggggagccaactaaaaccaagacatggatttccgaagctgatccgaacattgattcagtcgagtaaacaaaatccccccttctccggtaaagaaggagggatttgcggtgaagttgttgcgcctgtccttttaaagtttccccaaagctccccccaaatgaaaacatgagaatacatggttttacaaagcatctgaaagcaagcgattaaatttatcaacgccaagccttgatatatagggcttttaaaacatttttagttaaaagtctacaaattaatcagattattgtttataataagaataggcttaaacttaaataagcttataagaatttgttatgttcctctataagcataccggttatgtaaccgcaaccagtgaaatgtaagcattttcttaaaggggaaagggattgtttgcatgactcattttaagtaagccgtatgttttatatactctttaaaggggaattttgattgaaaaggagaggttgaatatgacagcaacacgcggtcttgaaggggttgtagcaacaacatcatctgtaagctctattatcgacgatacccttacatatgtagggtacgatattgacgacttgacagagaatgcaagttttgaagaaatcatttatttgctgtggcatctgcgcctgccgaataaaacggaacttgctgaactgaaaaaacagcttgcgaaagaagctgccgttccacaagaaatcattgagcacttcaaatcctatcccctcaataacgtacatccaatggctgcgctccggacggcgatttcattactcggtctgactgacagtgaagccgatgtcatgaatccggaagcgaactacagaaaagccatccgtctgcaggcgaaagtgccgggcattgtcgccgctttctcaagaatccgcaaaggacttgatcctgttgaaccgaaggaagagtacggaatcgcggagaacttcctttacaccttaaacggtgaagagccttctccgatcgaagtggaagcgtttaacaaagcgctcattcttcatgcggatcatgagctgaatgcatcaacatttacggcgagagtatgtgtcgccaccttatctgatatttactcaggcatcactgccgcaatcggcgctttaaaaggaccgcttcacggcggagccaatgaagccgtcatgaaaatgctgacagaaatcggcgaagtggaaaacgccgagccttatatccgcagcaaaatggagaaaaaggaaaaagtaatgggcttcggacaccgtgtgtataagcatggagacccgcgcgccaaacacttaaaagaaatgagcaaacgcctgacgaatctgacgggtgaaagcaaatggtacgagatgtcaatccgtgtcgaagaaatcgtgacgtcggagaaaaaacttccgcctaacgttgatttctattccgcatctgtctaccacagtctcggcattgatcacgatctgttcacgccgatctttgcggtcagcagaatgtcaggatggatcgcccatattcttgaacaatacgataacaaccgcctcatccgcccgcgcgctgattacacgggtccggataagcagacttttgttccgcttgatgaaagagcctgatcaaacgggaggctggtgattttcatgtcgttagcctcttgttaatcaagcccggattggtttacaattttgatagaatcttgagaaaagtcattttattttttatacaagaaaaataaaatgttttctaaatatgaattacatactgggaggtaatattgtgtcacaaggtgaaaaaattacagtctctaatggagtattaaacgtaccaaataatccgattatcccgtttattgaaggcgacggcacaggccctgatatttggaatgccgcttctaaagtattggaagccgctgttgaaaaagcatataaaggcgagaaaaaaatcacgtggaaagaagtttatgccggtgaaaaggcttataataaaacaggtgagtggcttcctgccgaaacactggaagacatcagagagtacttcatcgccatcaaaggtcctctgacgacgccggtcggcggcggtatccgttctctgaacgtggcgctgagacaggagcttgatttgtttacgtgcctgcgccctgtcagatatttcacgggagtgccttctccggtcaaacgtcctgaagatacggatatggtcattttccgcgagaatacggaagatatttacgccggaattgagtatgcgaaaggttctgaagaagttgaaaagctgatcagcttcctgcaaaatgaaatgggcgttaacaaaatccgtttccctgaaacgtcaggaatcgggatcaagcctgtttctgaagaaggcacaagccgcttagtcagagctgccattgagtatgcgatcgaaaacggccgtaagtctgtcacgcttgtccacaaaggaaacattatgaagttcactgaaggggcatttaaaaactggggctacgagcttgccgaaagagaatacggagataaagtattcacttgggctgaatatgaccgcattgtcgaaaaagacggaaaagaagcggctgataaagcgcagagcgaagcggaagcggcaggaaaaatcatcgtcaaagacagcatcgctgatattttccttcagcagatcttgacccgtccgagcgaattcgacgtcgtggcgacaatgaacttaaacggagactatatctctgatgcgcttgccgctcaggtaggcggaatcggaatcgcgccgggagcgaacatcaactatgaaacagggcatgcgattttcgaagcgactcacggaacggctcctaaatatgccggccttgacaaggtcaacccgtcatccgtcatcctttcaggagtgcttcttcttgaacacctgaactggaatgaggctgctgacttgatcattaaatctatggaaaaaacgattgcttcaaaagtagtaacgtacgattttgctagattaatggacggtgcaactgaagtgaaatgttcagagttcggtgaagagctcatcaaaaacatggactgaacctaaagcagacttctaatgaagccaaaaaaggagaagagaatcatgggaaaaacacgcagtaaagtttctgttatcggagcaggatttacgggagcgacaacagcctttcttacagctcaaaaagagcttgcggacgttgtgctcgttgatattccgcaattagaaaacccgacaaaaggaaaagcgctagacatgctcgaagcaagtccggttcaaggatttgacgcgaaaatcacaggcacgtccaactacgaggacacagccggttctgatatcgtcgtcatcacagccggaattgcgagaaaaccaggcatgagccgtgatgatctcgtatctacaaacgaaaaaatcatgagaagcgtcacacgtgagatcgtgaaatattctcctgactgcattatcgttgtattgacaaaccctgttgatgcgatgacatatgcggtgtacaaagaatcaggcttcccgaaagaacgcgtcatcggacaatccggagtgcttgacactgcgcgattcagaacattcgtcgctgaagaattaaacctgtctgtaaaagatgtgaccggttttgttcttggcggacacggtgacgacatggttcctctcgtccgttattcctatgcgggcggcattccgcttgaaacgcttatcccgaaagaccgtcttgatgcgattgtagaacgcacaagaaaaggcggcggggaaatcgtcaaccttctcggaaacggaagcgcctactacgcgcctgctgcatcactgactgaaatggtagaagccattttgaaagatcagcgccgcgtgcttccgaccatcgcttacttagaaggcgaatacggtcatgaaggcatttacttaggcgtaccgacgattatcggaggaaacggcctggagcaaatcatcgagcttgaactgacagactatgaaaaagcgcagctgagtaaatcagttgaatctgtcaaaaacgtgatgaaagtattgtcataagaaaaaagggaaggcttccgaatcagaagccttcctctttttacaattaatgaaagcgttttctttttccctgagcgatcctttctctgaaaatgatcaaaaaggcgaattgtctgaacgggcagtattggataaaatgaaatcataaagtgatatgcagcacataaaatagagaaaattggatgtcggggaaaatagacagcggagggcgcagcatgaacaaaaaaattttagttgtagatgatgaacaatctatcgttactcttttacagtataatctggaacggtccggctatgatgtcataaccgcatcagacggcgaagaggctctggagctggcagagaatgaaaatccggatttaatcgtactggatgtcatgctgccgaaagtggacggaatcgacgtctgtaaacagctcagacagcagaaaatgatggttccgatcttgatgctgacagcaaaagatgaggaatttgataaggtgctgggactggagctcggagcggatgattacatgacaaagccgttcagtccgcgggaagtcactgcgcgggtgaaagccattttaagaagggctgacatttcttcgctgtcacaaggcagagaagaggaaaaggacgggcagatcctcatcggcgagctgaaaattcttccggagcattacgaagcgtacttcaagtcagaacagctggaattgacgcctaaagaatttgaactgcttctgtatttgggaaaacacaagggaagagtgctgacgagagatcttctgctgagcgcggtctggaactatgattttgccggggatacccggattgttgacgttcatatcagccatctgcgcgacaaaatcgaatcaaataccaaaaaacccatctatattaaaacaatcagaggtttggggtataaactggaggagccaaaaatgaatgaataaagtccgtgtgcgtctgttcgctttactcgttgtatgtatcatattggttttcagtgttctcggcctttttttacagcagcttatttcttcatccgctgaagaaagaacggcggatcagctgaaaaaggaatcggtatacatagcgggccttcttgacaccggccgaatcggcaataaaagcaatgaaacggtaatccgtgacgccggccgcaccctcggtataaacgtctccttgctcaacgagaagggtgacgccgtatatcattccggcagtcgtgctgatgattcagccgtaaaggagttcatttctcacaataaaagcgaggaagccgtacagtcgaaaagcagagtcatccgcggcactgccgtaaaaaatgacgcagggaaaattgcggggtatgtactcgtttcctcggatatcaacggcggttcaagcgttaccggagaaatgtggggcatgctggcagcaagtctttgtaccgcttttatcattatcgttttcttttatacaaacatgacgtcgcgttacaaaaaatcaatcgacgccgcgacaaaggtggcgacggagctgtccaaagggaattacgacgcccgctcctacagcggttacgcaaggcggtcggaccgtctcgggcgtgcgatgaacagcctggcggtcgatttaatggaaatgacaagaacgcaggatatgcagcgcgatcgtctgttaaccgtcattgaaaatatcggatccggtttgattttaatagacgggagaggttttatcaatctcgtgaaccggtcatacacgaagcagtttcatacaaagcctgaacgtctgcttcggcgcctttaccacgatgcgtttgaacatgaggagatcattcggcttgtcgaagacatttttatgacggagacgaaaaaatgccagctgctcagacttcccatcaacattgagcggcgctactttgaagttgacggcgttccgatcatgggccctgatgatgaatggaagggcatcgtcctcgtttttcacgatatgacggaaattaaaaaattggagcagatgagaaaggacttcgtcgccaatgtctcccatgaactgaaaacaccgatcacctcgattaaaggatttacggaaacactgttagacggagcgatgaaagacgaaaaggcgctttcagactttctgtctatcattctgaaagaaagtgagcggctccaatctctcgtgcaggatttattggatttatccaagatggagcagcaaaactttacgatgcgcgtagagtcctttgatgctgcaaaaattctgcatgaaattgaggcgcttttgcagcataaggctgaggaaaaaggcatcagctttcagctcgatctcccggaagagccgatttttgtgacgggtgatgcgcacaggctgaagcaggtatttttgaatctggcgaacaatgccctgacctacacgcctgaaaaagggacggtggggatttcggtacatgtgaaagaaaccgttgtcgatatcaaagtgtccgatacgggaatcggcattcagaaagaagagatcccgcggatatttgagagattctaccgcgtggataaagacagaagccgcaactcgggaggaaccggcctcggcctcgccattgtgaagcacttaatagaagcccatgaaggtaaaatcgaggtcacaagcgagcctggacagggaactgtgttcactgtgacgctgaagcggccgccggcagcgtgatcagctttacaaaggattaacaatttcttcatgacctgttaaacctatcttgttaggatataacagaaccccttcatccaaggagccaattttgacggcgggaacgcgttttcttgttcccgtccttttttgcgttttcacggggtccgctcattttcctttcaaattgaactttgttaaaataagagaagctgtgagattaaaaaacagaggaatgacgagcttttgctcttaggaggatattgaatgacggaacgaaaaaaattagtgcttgtcgacggaaacagtctggcgtaccgggcgttttttgcattgccgcttttaagcaatgaaaaaggcattcatacaaatgccgtatacgggtttgcgatgattttaatgaaaatgctggaagatgaaaaaccgacccatatgctggtggcttttgatgcgggaaaaaccactttccgccacagcacgtttaaagaatataaaggcggaagacaaaaaacgccgccggagctttcagaacagatgccgttcatccgcgagctcctcgatgcctacaacatcagccgctacgagcttcctgaatatgaagcggacgatattatcggcacgcttgccgtatctgctgaaaaagacggctttgaagtgaaggtcgtttcgggggacaaggacttaacccagcttgcaaccgggaaaacgaccgttgccattacgagaaaaggcattaccgacgtagaagattacacgccggagcacgtgcgggaaaagtacggtctgactcctttgcaaatcattgatatgaagggattaatgggagattcatccgataacataccgggcgtccccggcgtcggagaaaaaaccgcgattaagctcttaaagcagttccattcggttgagaaactgcttgattccattgatgaagtcagcggaaaaaaattaaaagaaaagcttgaagaatataaggaacaagccctgatgagcaaagagctggcgacgattatgacaaatgcgccgattgaagtcaagcccgaagatttagattaccaagggtttgaccgtgaacaagttgttgccatttttaaagacctcggttttaatacgcttcttgagcggctcggtgaagaaagcggggaaacggcggaagaaaattttgaagacatcaatgtcgaaacagcagaagaaatcaccgaagatatgctcgtttcgccgtccgctttggtcgtcgaacaaatcggtgataactatcacgaagaaccgatcctcggcttttccatcgtgaatgaaacaggtctttattatattccgaaagaaatcgccattcagtctgaagcttttaaatcttgggctgaagatgaatcgatgaaaaagtgggtgttcgacagcaaacgttccgtcgtcgctttgcgctggcagggaattgagctgaagggaacggaatttgacgcgcttcttgctgcctacattataaacccgggcaattcgtacgacgatgtcgcgagcgtagcgaaagaatacgggctgaatatcgtttcaaaagatgaagcggtatacggaaaaggcgcaaaacgcgccgttcccgctgaaaaagagcttgccgatcatctcgcgcggaaagcgtctgccgttaacagcctccgtgacaaactgcttgacgctttggaagaaaataatcagcttgagctttatgaagatcttgaactcccgcttgcgctaattctcggagaaatggaatcaatgggcgtcaaagtggatgtggaaagactgaagcgaatgggagaagagctcaaggcaaaactgaaagaatatgaagaaaaaatccatgacatcgccggtgagccgtttaacatcaattcaccaaaacagctcggcgtcattctgtttgaaaaactcggcctgccgccagtaaagaaaacaaaaacaggctattccacttcagctgatgtgcttgagaagctcgcagacaaacatgatatcgtcgcgtacattctgcaatacagacaaatcggcaaactccaatcgacttatattgaagggctgctgaaagtcacgcgcaagggttctcataaggtgcatacacgattcaatcaggcattgactcaaaccggacgcctcagctcaacggatccgaacctgcagaatattccgatccggctggaggaagggcggaaaatccgtcaggctttcgtaccgtccgaaccggactggcttattttcgccgccgattattcacaaattgaattaagggtgcttgcgcatatttcaaaagatgaaaatctgatcgaagcgtttacgaatgatatggacattcacacaaaaaccgccatggacgtgtttcatgtcagtgaagatgaagtgacacaagcgatgcgccgccaggcaaaggccgtcaatttcggcatcgtttacggcatcagtgattacgggctgtcgcaaaacctcggcatcacccggaaagaagcgggcgcttttattgaccgctatttggagagcttcccgggcgtcaaggcgtatatggaagaatcggtgcaggaagcgaaacaaaaaggatatgtgacgacacttatgcagcgccgccgctatatccctgagctgaccagccgcaacttcaacctgcggagctttgcggaacggacggccatgaatacgccgattcagggaagcgccgccgatattattaaaaaagccatgattgacatggcagctgagctgaaagaaaaaaacctgaaggcgcgactgttgcttcaggtgcacgatgaattaatttttgaagcgcctaaggaagaaattgaaatattagagaagctggttcctgaagtgatggagcatgctttggcattagacgtgccgctgaaggcggattatgcttcagggccgtcttggtacgatgcaaaataaacagaaaaaaaggaagtgatgattgtgccggaattaccagaagttgaaacggtccggcgcactctgaccggtcttgtgaaggggaaaacgattgaatcggcggatatcagatggccgaatatcatcaaaaaacccgccgagccggaggaattcgcgcggcagattgcaggagaaacgatccgatccatcggaagaaggggaaagtttttgcttttccatttggatcattatgtcatggtgtcacacctgcgtatggaggggaaatacggtcttcatcaggccgatgagcctgacgataaacatgtgcacgtcgtgtttcacatgacggacggaacacagctccgctaccgggatgtccggaaattcggcacgatgcatttgtttgcgccgggagaggaacggaatgcattaccgctttcacagctcgggcccgaacccgatgatgaagcatttaccgccgcttatttaaaagagcggcttgcaaaaacgaaccgcgcggtaaaaaccgccctgctcgaccaaaaagcggtcgtcggcctcggcaatatttatgtcgatgaagctttattccgggcgcgtattcatcctgaaacaaaagcgaacagtctgtcggacgggcagataaaaacgcttcatacagaaattaaagacacccttcaggaagcgattgacgcgggcgggagcaccgtccggtcttatatcaattctcaaggggagatcggaatgtttcagctcaaacattacgtctacggcaaaaaggatgaaccgtgcaaaacgtgcggcacgatgatttctaaaatcgtggtcggcgggaggggcactcatttttgcgcccgctgccaaaaaaaatcataaactgaagctgttcaagcaggcggcagcagaatgacttttttctaacacagttgatgacctttctccatatatatattgtgattcacccaataggcatatgtcacaattgccgatcaagagaaagggagaaacggatatggagattgtttctttgctgcttttggcttttgctgtcagcttggacagtttttcagtcgggtttacgtacggtttgagaaaaatgaaaatcccgttcaaagcgattgccgtgatcgcctgctgttcagcctctgtgatgtttatatccatgctgatcggccattttctgacaaagatttttcctgtatccgtcacggagaaactgggcgggctgatcttaatcggaataggggcatgggtcatctggcaattttttaaaccggctaaagagccggattacttattgcatgaaaaaacgctgcttaatcttgaagtgaaatcgctcggcatcgtcattcatattttgaaaaaaccgaccagcgccgatattgatcaatccggaaccattaacggagtcgaggcgcttctgctcggtatcgccttatccattgacgcgtttggcgccgggctgggagcggccattctcggcttttctccggttatgatgagcgtgactgtcggggtgatgagctcgctgtttgtttcactcggcataaacgcggggcatttgctttcaaggtggaattggatagataaaatgacatttttgccgggagtcctgctgattatcatcgggatttggaaaatgtaagaaggagtgggctttttgagcttggtcatcggtttaacgggaggcatcgcaagcggcaaaagcacggtagcgcgtatgctgatcgacaaaaaaataacagtcattgatgcggatgtcatcgcgaaacaggcggtggaaaaaggaatgccggcttacggacaaattgtggaagcattcggaaaagacatcctgctggaaaatggcgatattgacagaaaaaaactcggttctatcgttttcactgacgaacagaagcgtctgaagctgaatcagatcgttcatccggcagtgcgtgcggaaatgctgaaacagcgggatgaagccattgcgagaaaagagcagttcgtcgttttggatataccgcttttgtatgaaagcgggcttgattatcttgtcggcaaagtgctcgtcgtcaccgtaccggcagacattcagctcaaacggctgatggagcggaattccctgacagaagaagaagcgatgagccggataacgtcgcaaatgcctttagcggacaaagcaaaaaaagctgacgccgtcattgataacagcggcagtcttgaatatacaaagcaccagcttgaggaagtattgagcggctgggcataaacaaacaccgttcggaaagccgaacggtgtttttctggttaaaaatcaaaattgtcagggtccggaccgacacggagattttcgttcagatcatcaatccgcttcatatcttcagctgacagttcgaaatcaaagacatttgcattttcttcaatacggtgttttttagttgatttcggaatggtgatgacaccgttttgcaaatcccagcgcaaaatcacttgagcggctgatttgccgtatttctcagcaatctcctgtaatacggggtgatcaagcagctgcccttgcatcaatggcgaccacgcttcaagctgaatgccttgttcagtgcagaaagcaagcagttctttctgtgtcaggcgcgggtggtactccacctggttgatcatcggcttgatttccgtttctttcatgagatgtttcaggtggtgaatttggaaattgctgaccccgatcgccttaatgcgtccatcccggtagagggtttcgagcgcccgccacgcatcgatgtactttccttcgacaggccaatggatcaaatataaatctaaataatctaaaccgagtttttctaagcttgtgtcaaacgcttttaacgtttcttcatatcctaaatcggcattccatacttttgacgtgacaaaaatgtcttcacgttttaatcccgcttcttgcagcccttggcggatcccttcgccgacaccttcttcatttccgtaaatcgcggcggtatcaacgctgcgatagccgtgcaccaatgccgttttcaccgcgttgacgagttccgcgccttcctctactttgaaaactccgatgccgaaccaaggcatctctactccgttatgcaatgttgcttttgcttgtaaatgtgttgtcatgtatatattcctcctattatttgtctgtcgaaaaaaatcaaaatgcgctgaagaaaaactcacctcctttcaagggcagtgcgatcccgcttttccagcttcctgctccatccggttaatacgaccgcgctgagcaccatcagcgccccgatccaagcggtatgaatgattccgattgagtctgtaatgattccgccggcaaacgagccgatcgcgattccggcattaaatgccgcgatatttaaggctgatgctgtatcaacggcgcttggcgcaaaacgttcactcagcatcacgacatatacctgaagccccggcacattcataaacgccaacagccccatgaaaataatggtgatcagcccggctgttttaaacggcgcggtaaaagtcaggacaaacagcacagctgcctggacaatgaacatataaaacaaggctttcagcggattccggtttgataaacggccgccaatcatgtttccgatggcaatcgcaattccgtaaatgagcaggatggccgcgacggtttctttctgaaaacccgttacctcctgaagaagcggagataaatacgtaaacacgacaaacgttccgccgtagcctaacgctgtaataataaataaaagcaataaccggccgtttgtgacgagtttgacctgctcggaaaatgcggttttcgtccctttgcgcaaatgagacggaacgagaagcgcgtttgtgaggaatgcgatgattcctaccgccacaatcacggcaaatgcgattctccatccgaattgctggccgagataggtgccgaacggaacgccggtcaccgtagccaccgtcagccccgtgaacataatggaaatcgcgcttgctcttttatgctccggcacgatattggcggcgatcgttgccccgattgacatgaaaatgccgtgggaaaaagccgaaatgacccgtgccgccagtaagacgccgattgaggaagcgctcgctgcgagtgtatttccggcgataaaaatcaacatcacccagagcagcagtgttttccgcgacatgccggatgtgagagacgttaaaaccggcgcgccgaatgtcacgcccagagcatacatggaaacggtaagtcccgccgttgtcacaggtatatgcagatcttgagatataagcggcagcagtccgacgctgataaattcggttgtgccgatcgcaaaagcgctgacggctaatgccagcagcgctggtaaatagctttggcgatgtgaagacatctgttttcctccttaaacgataatgtatggttgaaatgatgccgggtaaacgatataagtataagagtacattccttttcagccggcaaatgtcattatgattgatagaagtgtcattgaaaagaacgtacttttaagtgccataggcactttttagttcctatagatgaggaggaattaccgttgctgaagaaaaaatacaatatatccgtagaggcggcgcttgaagtgatcggcggaaaatggaagtgtgtgatcctctgccacctcatgcgcgggaaaaaacggacaagcgaattgaagcggcttatgccggacatcacccagaagatgctgacacagcaattgcgggagctggaagctgacggcgtcatcaaccggatcgtgtacaatcaggtgccgccgaaagtggaatacgagctgagtgaatacgggcacagtctggaaagaattttaaatgcgctgtgtgactggggcgcgatgcatattgctaaacggtacggcgaggtgtcttccgttttagaggacagcattttgaatgacaaatttaaagaaccgggacaaatataagaaaaaagcaggcagcctgagacgctgatcctgctttttttatggaagaaaaatcattttatatgcaaaaaaaccgattgaacaacatattgatcggtataagggtggatttttatcaagttgtactggcggatttcttttaatgtgttatactatatataaataaaggtaaattagagtggcatattaaaaaggggtgacctgagcatgaaggtaaaagtagcaataaacgggtttggaagaatcggaagaatggtgttcagaaaagcaatggaagatgatcaaattcaaataacagccattaatgcaagctatcccccggaaacgcttgctcatttgataaagtatgacacaattcacggcaaataccatcaagaagttgagaccgccgacgacagcctgatcgtcaacggaaaacatattatgctgttcaatcgccgggacccgagagagcttccgtggaaagaatgcggaatagacatcgtcgtagaggcaacggggaaatttaattcaaaagaaaaagcgatgagccatattgaagcaggggcgaaaaaagtcattttaacggctccgggcaaaaatgaagacgttaccattgtcatgggagtaaatgaagagcagttcaatcccgatgaacatgtcattatttcaaatgcatcctgcacgacaaactgtcttgcgccggtcgtcaaagtgcttgatcaggaattcgggattgaaagcgggctgatgacgactgttcacgcttacacgaatgatcaaaaaaatatcgacaatccgcataaagatctgcggagggcgagagcgtgcggagaatccatcattccgacttctacaggcgccgctaaagcgctgtcgctcgtgctgcctcatttgaaaggaaaacttcacggtctcgctttgcgtgttcccgttccgaatgtgtcattagtggaccttgtctgcgatctgaaaacagatgtgtcggccgagcaagtgaacgccgctttccaaagagcctcaaaaacgtcgatgtacggaattcttgattattcggatgagccgctcgtttcttcggattataatacgaattcacactctgcgatcatcgacggactgacaacgatggtgatggaagaccgaaaagtaaaggtgctcgcctggtatgacaatgaatggggatattcctgccgggtcgttgatcttatccgtcacgtcgccgcgcgaatgaaacacccgtcagctgtgtagactaaagatcatggacatttgttagaaaaaaacccttaacggcatattcgcaaaaaacacaccttgcaaaataaacttaaacacagtatactatctttcgtgaacttcttgctcgtgactgcttcggaattacttaaagggttaggacctctccggactaactttcccccgtggtaaatggccgggtcagttctcggaaattcacttttttaattcttgttaaggggggtccatgattatggaaacaatggggcgtcacgtcatctccgagctgtggggatgcgattttgataagctcaatgacatggattttattgaaaaaacgtttgtaaatgctgctttgaaatcaggagctgaagtgcgcgaggtcgcatttcacaaatttgcaccgcaaggcgtaagcggagtcgttattatctctgagtcacatttaacgattcacagttttcctgaacacggatatgcaagcattgatgtttatacttgtggagacctggatcctaatgtggctgcggattacattgcggacgcattacatgcagatacaagagaaaacattgaaataccgagaggaatggggcctgtacagattaaacaggcacaagcgaaagtactgtaattttcaaaacgcaaacacaagggagctaagctgaaaaagccattacgcgctttgaagctgatgctccttttctaatgtaaaaaaacagcattgctttttctttaagcattttttttgtaaaatagaaaagataaggccggtctatcggctctcccaacaaataggctcatcctagaaacgttggcgggcatttaccggaagcttgcgaaccgcattacagcaacgaaacagatgggagctgatccaatttgaaatgtccttcatgccagcataacggttcccgcgtacttgattcacggcctgcggacgaagggaaatcaatccgcagaaggcgggaatgcgaagcctgccattaccgcttcactacatttgagaagtttgaagagatgcctctgatcgtcgtgaaaaaagaaggcgtccgggaagaattcagccgtgaaaaaatgctgcgcgggttaattaaagcttgtgaaaaaaggcccgttcctttgaaaacattggaagacatgtgctttgacattgaaaaagagctgagaaaccaaggcgtatctgaagtcaaaagcgaacttgtcggtgaaatggtaatggaccgcctggcgaaaatcgatgaggtgtcttatgtccgctttgcctccgtctaccggcagtttaaggatataaacgtgtttatcgatgaattgaaagatttaataaagaaagaacgctgagagagctaagagattgtgtctggctcttttctcatgagcaaaattggcatttgatagatcgcagaaacggtgtaaaatgagagtagaaacatatcggaaggtttgagaatcatggctgactattggaatgacgtattgcctgtagatccttatacggtcaaaagccgttcgcttcttcaggatgtcgacagacaggttttgacacatctgtaccagccgctgatcggttcttttgcattctccctttatatgaccttatggggggagcttgagcagaaccgcttgtggggagcggaatccacgcacaggcagctgatgggcatgatgcagtcaaatttaaaaaagattcatcatgaacagggaaagcttgaaggaatcggactgctgaaagtgtatatccgggagtccgagcaaaaagagcggatgtttatttatgagctgctgcccccgctcaggccgaatgatttttttgaagacggcatgctgaatgtctttctttataacagagtcggtaaaacgaaataccagcagctgagacaattttacacgcacccttccgtcggcgcgggcgcaagggaaattacccgtccgtttaatcacgcttttgcctcttttcagccgagtgaatggaaaatgacgcctgatatggaagaggcgatgaagctccccgaggactatgagacggcgtctgtcggacaagcgccttcctatacggtgacggaggaagtgtttgattttgagctgtttttggcggggttatcagaaacgatgataccgcgcaaatcaatcacacaggatgtgcgggagagcattaaaaagctttcatatttatacggaatagatcctatctccatgcagcacgtcgtcatgaccgcaattaatgagcaggatacgataacggccgaagcgctgaggaaagcggccagcgactggtaccaaattgaaagaagcggcaagcttcccgaactgattgataaaacacagcctgtcaccttgagagaaaaccggacggaaaaggacgattcattgaacggcgaactcatcgcacagcttgagaccatatcaccgagaaagcttctccaggacattgcggacgggaccgagccgtcaaaagccgacctgcagattatcgccgatattatgttcgaacaaaagcttgagcccggcgtcaccaatgtgctgatttattatgtcatgctgaaaacggatatgaagctgtccaaaaactatatccaaaaaatcgccgcccactgggccagaaagaaagtcaaaacggtacgggaagcaatgaagctcgcaatcgaagagcacaggcaatatcttgattgggcggacggcaaaacaaacggcgcggcgcgcggcaaaaaaaccgtccgggaagaaaagcgccctgattggatgaaagaagaagaaaccgggaagaaacaagaacagacggctctttccgcacaggatcttgaagaacagaagaaaaaaatgatggaagaaatgaaaaaactgaaaaaatactctgcctattgagacagagaagcggggtgatattgaatggaaccgatcagccgatccttagaaggcgtgacgaaaagacctgactttcaaaaacgcctggaacgaatgcagcagcaagttatggccgacgaagacgtccaggcttttttgaaggaacagaaagatgttatcaatcaaagcatgattgacagagggttaaataaactgtacgaattcgttcagcaaagtaaacagtgcgccttctgttcgaaagacagccggacgaacagcctgcttgaaggctaccatccgaagcttgtgatcaacgggcgttccattgatattgaatattacgaatgtccggaaaagagaaagctcgaccgccagaaaaggcaaaagtccctgatgaagagcatgtatatccagcaggatcttctcggcgcgacgtttcagcagatcgacattaccgatccgagcagactcggcattttccagcatgtgacggattttctgaagagctataatgaaacgggaaaaggcaaagggctgtatctgtacggaaaattcggaatcggaaagacatttattttagccgccattgccaatgaactggcggaaaaagagtattcatcaatgatcgtatatgttcccgaatttgtcagagagctgaaaaactcgcttcaggatcagtcgctggaggcgaaactgaatatggtgaaaacgacgcccgtactgatgcttgatgacatcggagcggagtcaatgacaagctgggtcagggatgaagtcatcggcaccgtgcttcagcacagaatgagccagcagcttcccactttcttctcgtctaatttttcaccagacgagctgaagcatcattttacgtattcacagcggggagaaaaggaagaagtaaaagcggcaagactgatggagcggattttatatttggcttcgcccgtccgtcttgacggggaaaaccgccgccgttcatgatgccggcgtccaatgggaaggatttgagggaatgaggaataagaaggctgtcacttgggctgcggctgcggcgggagcgggtcttttgctgtgggcaaaccgcaaatatctgaatctgtcgcctaaggagatccggctgtgggtgttatcgttcggtgtttttgcgccgcttgtgtttatcggaatttccatcgtcaggccttttgtgctgtttcccgtatcaatcgtttccgtcgccggaggattggcgttcggcccgtttttcggcaccatgtatacgctggcgggctcaatgggcgctgccgccgcgtctttttttgcggcggggctgtttgcctttaatgagaaaagccgtcatggaaaaatggaagccattcaaaagcagatgaaaaccaatggcttcttttatatttttatcctgcgcattctgcctgttaactttgatgtgatcagctatgccgcgggcctatcgaaagtcaggccggtaacgtattttttggcgaccgcagcgggcatcattccggggacgatcgtcctgaatgtgctcggcgcgagctttatgtccggcaatgtgctggccgtactctgcgtgatctgtctttacgtcgtatttttatcgcttcccgttatatttaaaaagaaggtgcgtcatttgttcggcggtgaaagctaacctttacgtctattttaaaaacatcccccatatacttgtaacagatgccgtaaggggggacaaatatgcttgaagtgatctttgaagatgaccacgataccgccgcttttttacatctcattcagcaatcggacgaccggagacattttattgtccgtgaaggcataaaaaaagtcggaatcgcaaggtctgaaacggctttttgcgttcagcgctttattgagccgatacttgtcaggttttttttggaatgcaaagaagacgagcatatgctttcgcttattgaggacgcatactgcttcaccgatcaggatgaacagcagcaaatccttcagcttgcacacagcattatggaaggagagcttgaggatcatccgtttgagccgaagaaagagccgcgcacacagtttatttcagatgcgctccgaacgatttcacttgatgcgggtgttttttccgtgcgttcgtttcagacgttccggctcggcaggtattatgagaggctcagagaatatacggaggccgcgatagatgaataccggatggaacaggaatatcaaaactttatccagtctctgagagattatgtgacatccaatccgccgcggatgaagaaagtccgcatcgtacatgaccgggcttttacgctgtgggagctgcgctatgtgtctgaacgggaacagaaaaaatacatagacagacggtttgtgcgggagcacccgatgtatatagattcccatctccttgcgccgctgatctccattgcgcctgagacggtcgaactgtatacggacaaaccggaacatatgatgtcaagaaccattcaaaacgtgtttcaggagagggtgcgcctttttccgctgggcgcgtttgcagccgagaagacggaaggatagccgcacggacggccttgtgtaagcggcagggctgtctgtgcgaaatcagacggaaaaccgagttgcatttttctcacagacattttataatacataaaagattaatgattgctacacgtattgataaggacatgaagcattgataccggctgtataagagaggagagcccaggctgaaagctttccagctatggatcattgtctttaccgcctttgaacttcagctgtgaacgccggaataagcgccagtaatagctgacgggaactcccgttacagagcttagagccgcagtgccgaagcaatcggccgcgcggaaaaaagggtggaaccacgattccgtttatttaacctcgtccctttcatagggggcggggtttttgatttgcataaaaaaaggagtgacgaagatgtcagatatgatcaacatcacatttccggacggagcggtaaaggaatttccgaaaggaactacaacagaagatatcgcggcatccatcagtccgggattaaagaaaaagtctttagccggaaaactgaacggacaggaaattgatttaagaacgccgattcaagaggacggtgccgtagaaatcattacagaaggcacagaagaaggtttgaacatcatgcggcacagcacggcgcatttattggcccaggcgattaaacgcatttataaagatgtgaaattcggagtcggccccgtcattgaaaacgggttctattatgacgttgaaatggagcaggcgctgacgccggatgaccttccgaagattgaaaaagaaatgaaacgcatcatcggtgaaaatctgccgatcatccgaaaagaagtgagccgtgatgaagcaaaagccatgtttgcggaaatcggcgataatctgaagcttgaactgctggatgcgattccagaagacgaaacggtctctatttatgagcagggcgaattttttgacctgtgccgcggcgtgcacgtgccgtctacaggcaaaattaaagaatttaagctgctgagccttgcgggcgcatactggcgcggcgacagcaaaaaccaaatgcttcagcggatttacggcacggctttctttaaaaaggatgacttgaaagagcatttgcgcatgcttgaagaagcgaaagagcgtgaccaccgaaaactgggcaaagaattaaaattgtttgccaactctcaaaaagtcggacaaggtctgccgctctggctgccgaaaggcgcgaccatccgccgcgtgatcgagcgctacattgtggataaagagctgagcctcggttatgagcatgtgtatacgcctgtcctcggaagcaaagacctgtacgaaacatcagggcactgggatcattatcaggatacaatgttccctccgatggaaatggacaatgaaacactcgtgctccgtccgatgaactgtcctcaccatatgatgatttacaaacaggacattcacagctaccgcgagcttccgatccgcatcgccgagctcggaacgatgcatcgttatgaaatgtccggggcgctttcaggtcttcagcgcgtacgcggcatgacgttaaatgacgcgcacattttcgtccgccctgatcagattaaagaagaattcatccgcaccgtccgtttgattcaagacgtatacgaagacttcggactgagtgattacacattccgcctgtcttaccgcgatcctgaagatacggaaaaatattttgatgatgatgagatgtggaacaaagcgcaatccatgctgaaggcggcaatggatgagatggggcacgactattatgaagcggaaggcgaagcggcgttttacggccctaaacttgacgtgcaggtgaaaacggcgatcggcaaagaagagacattgtcaactgtacagcttgacttccttcttccggaacgctttgatctcacttacgtcggagaagacggcaaacagcaccgccctgtcgttattcaccgcggcgtcgtatcaacgatggagcgtttcgttgctttcttaatcgaagagcacaaaggcgcccttccgacatggcttgcgccggtgcaattccaagtcattcctgtatcaccgtccgtgcatcttgactacgcgaaaaaagtgcaggagcgcctgcagcgcgaaggcctgcgtgtcgagcttgacagccgggacgaaaaaatcggctataaaatccgtgaagcgcaaatgcaaaaaatcccgtacatgcttgtggtcggtgaccaagaagcggaaaacggcgcggtaaacgtccggaaatacggcgagcagaaatcagaaaccgtctcattggacgattttgtgaaaaaggctgtagcagaagcgaaaaaataaccggaaatacaaaaaaccccgttcattcagaatggggtttttttgcgtataaaattatctttctttttgtttctctataatcgcaaacagctcgtgaagatcgctgatcacgtaatcaggcgcaatgtccgtatcatttttcttttgtgtccggtttacccagactgtcgtaatgcctgcccgtttcgctcccaatatatcagtattgaggttatctccgaccataatggcgtcttcttttttcaggttcaggaggccgaggcaatgttcgaatatggaggcatcgggtttcccttttccgaaagcgcctgagatgacgatttcattaaaataaggcgcgagctcaggaacgccggctagtttttctttctgcaggctgggatcgccgtttgtcagcagaagcaattcataaacacctttcagcttatcaagcaccgcaaacgtttcatcatacacatacgggcgctgtctgcgttccgccgcgaaaaactccgccaaatattcgccgtaagccgcatcgtctataccgacgctttttaagccgttcgtccaggcgtttcgtctgtattccggcgcaatccgattcagctgtttaaatccttcgctgaccggctcggaaaaattcgcccataatccttcaaacggattaatgccgatcatgaccgtataaggataggtttcgtatgacatatacaattcccgtgccgctttccgtaccgcctcttcaaatgtttgcgggtcaaggccatattttttttccgcttgtaaacatgtttccctgaatgttgttctgacgcttttttcatcccataacagtgtatcgtccaaatcaaaaaatacggctttcatgatcttctcctctttgttatattctgaaactctctgccgcaaggctcccgtttattctacaatagatacatagactgtgaaagatttgttttcagatgatttgaaaaaaacaggcaggtttgtgtcagattctgtctcgggctctaaaacgtgataaaataaaatttgaaagaacaggtgaaaagtatgctgcatttgatcatcatgatgctggaaagagtcggaattatcgtcatattgggatttgttctggctcataccagattgttcagacaggcgctccagcagcctgagagctataaaggcaaagcggtgctgatttcaattttctcgctgttcagtatcatcagcaactatacgggaatagaaattcagcagaatacaatcatgaataatgactgggtgtttcaaattaatccgtccggttcaattgccaatacaagaattatgggcgttgaaatcggcggactcttaggcggcccctatgtggggatcggcgtcggcatactggccggcctgcatcgtttatcactcggcggcgcgaccgcagtcagctgtgccgtctcatccgttttagcgggcattttgtccggctggatcggacggtatttcagaaaacgctacaggatgccgacaccgcgtgtggccgcgcttgtcggactcgggatggaatcgctgcaaatgctgctcatcctcttgatggccaagccgttttctgacgcttggacgcttgtgagcatcatcggcatcccgatgatattggtaaacgggtcagggacttttatttttctttcgatcattcagtcgattatccggaaggaagaacgggcgagagcccttgaaacccacagggtgctgatgattgccgatcagacgcttccgtatttccgccaggggctgaatgaaagctcatgcaaaagcgtcgccgccatcattcacaggcaaacaggaacggacgcggtatcgcttacggataacgaaaagattttggcgcacgtcggcgcgggtgccgaccatcatattccgtctgaaagcctgattaccggattgtcaaagcgcgttattaaaacgggtcatattatgaaagcgacatcaaaggaagaaattgaatgcacgcacgatccctgtccgctgcatgcggcgattgtattgccgctgacgtcaaacggcaaaacgatcgggacgctgaaaatgtactttaaaagcccgtcaggtttaagccgggttgaagaagagcttgcagaaggactcgccatgctgttttccacacagcttgaactcggcgaggcggaactgcagagcaaattgctgaaagacgcagaaataaaagcgcttcaagcacaggtcaatccgcattttctgtttaatgcgatcaatacgatttctgctctttgccgtacggatgtagaaaaaacccgaaagcttctgctgcagctcagcgtctatttccgttccaatctccagggggcaaggcagctgctcatcccgctttctaaagaactgaaccatctgcaggcgtatttatcattggagcaggcccgttttcctgggaaatataaaatcagccttgaaatcgaacgcggtttggaggacatcgaaattcctccttttgtgctgcagattctcgtcgaaaatgcgcttcgccatgcattttcaagaaagcaggacagctgtgccgtcaatgtgagcgtggtatccgccggtcagtcggttttaatgcgggttggagataacgggcggggaattgatccggaattgctgtccgtgctcggaaaccgtccgctcccgtctaaagaagggacgggaaccgcgctttacaatttaaatcagcggctgatcgggctgttcggccccaaggcagccctgcgattggaaagtgaggccggcaaaggtacggacgtatcatttgagctgcctttgaaactgatgactaaaggagaagaacatgctgaaggtgttaatcgttgatgatgaaatgctggcaagagatgaattagcttatttgctgaaacggacgaatgaagtaagtgacataaacgaagctgaaaatattgaatccgcttttgacagtatgatggatcaaaaaccggatctgctgtttttggacgttgatttgtcaggagaaaacggatttgatattgccaaacggctgaaaaacatgaaaaatccgccggccgtcgtttttgcgacggcgtatgaccaatttgctttaaaagcttttgaagtcgacgcactcgattatttaacgaagccttttgatgaagaaagagtgcgccagacgatcagaaagtttaaaagagtgaagcaggacagggcaggagccgtctcggagctgccgtccgcagccggagcgcataaactggctgtatcagccggtgaatctattgtcattttagatacgaaggacattatttacgccggcatggaggacggacacgtttccgtcaaaacgtttgccgcgtcttattccgttcatgaaactttggcggtcattgagaaaaaactgcctgatacgggtttcttgagagtgcaccgcgcgttcatcgtgaatacggagcatattacggaaattcatccgtggtttaattcgacttacaatctgatattaaaagacggttctaaaattcccgtcagccgtacatacgccaaggacttaaaaaagctgcttcatattatatgaggcggcttttgcatttcagcagccgttttttgcatttcagaatgaatattcagccgtttgttatgaaagcgctttaaaaatcgatttctcttttataatggacctaacaaagagaaagaggtgaagaaaatgagtgcgaaaaaagtgtacggatttctgacacaagcatttatttttgccgtagttatgctcatatctaatgggattgcagcgattgtccccattcctatacccgcttccgtagtaggtttggtgttattatttgtcctcttatgcctgaaagtgattaagcttgaacaagtagaaacgctgggaacatcattaacgtcactgatcggatttttatttgtcccgtcgggcatctccgtgatgaattcacttggcgtcatgcagcagtacggcgtgcagatcgcactcgtcatcttactcgccaccatcattctgttaggggcgacaggccttttttctcagctgatcttgtctgtcagccaaaaacgtcagaaggctgctccggctgataaacaaacggtgcgccgttccaatcaggaaaacgaacttgtgcagcattaggagggaaaacggatgagtccatatttcggtattgtcgtttcacttgcggcctttggcatcggcacgtatttatttaaaaaaacgagaggctttttcctcttcaccccgctgtttgttgcgatggtgcttggaattctttttctgaagctcggcggtttttcgtatgaagattataaaagcggaggagacattattaaattcttcctggagcccgcgacgatcgcttttgccatccctttatacaaacagcgtgccaagctgaaaaaatactggtggcagatcatgtcttccatcattgtcggctctatctgctcagtcacgattgtctatttgatcgcaaaaggcattcatctcgacgcggccgttatgaaaagcatgcttccgcaggcggcgacaacggcaattgcccttccgctgtcaaaagggatcggcggcatcaccgacatcaccgctttcgccgttattttcaacgccgttatcgtctatgctcttggcgctttattcttaaaactgtttaaagtaaagcacccaatctctaagggactggctctcggcacatcaggacacgcactcggtgttgcggtcggcattgagatgggggaagtagaagcggcaatggcaagtatcgcggttgtcgtcgtaggagtggtgacggtgctggtcattccggtattcgttcagctcatcggaggataaacccgggtcatagacccgggttttttattgtgttggcacgtccgcgggcggcaaagaacgaaatttcacatttttccttgcgctcaccccggcatcgtgttaaaatgaaaaagttgatccggagaagtcattcttgactaatgatccggtattgtgtagaatagttattgaattgaatataaatcacaagcagaggcacccgcttctcacctgattgacacattcatgtagttggcaggttgaccgtacatttttatttatgcagatgttcgtagtgtgggtgtgttgtcatgcccgcactttttgtttgcctgcagaatgcagtcaaaaagcgttgtgaatcaattcgaagaaactatggaggtggctcattattagcaaagatcaattggttaatgagggtatccgtgcacgtgaagttcgtctgatcggacaaaatggcgatcagctcggcatcaagtcccgtcaggaagcacttgaaatcgccggccgcgcaaatcttgaccttgtgttagttgcagcaaatgcaaaaccgcctgtctgccgcatcatggactacggtaagttccgattcgagcagcagaaaaaggacaaagaagcacgcaaaaatcaaaaaatcattaacttaaaagaagttagattaagtccgacgatcgatgagcatgactttaacacgaaattgcgcaatgcgattaaattccttgaaaaaggcgataaagtgaaagcttctatccgctttaaagggcgcgcaatcactcataaagaaatcggccagcgcgtattggaccgtttctctgaagcatgtgcggaagttgcgacagtcgaaacaaaaccaaaaatggacggccgcagcatgttcttaatgctcgcgccgaaaaacgaaaagcaataaggaggaaatcccatgccaaaaatgaaaactcaccgcggatctgctaaacgttttaaaaagacaggttctgggaagttaaaacgttctcatgcatacacaagtcacttattcgccaacaaatcccaaaagcaaaagcgtaagcttcgcaagggtgctattgtgagcgcaggagacttcaaacgcatcaaacaacagcttgccaacatcaagtaatcggacaaggaacaattaggagggaaatctaatgccaagagtaaaaggcggaactgttacacgtaagcgtcgtaaaaaggttcttaaattagcaaaaggttatttcggttcaaaacatacattatacaaagtagcaaaccagcaggtcatgaaatcaggaaactatgcattccgtgaccgccgtcagaaaaaacgtgatttccgtaagctttggatcactcgtatcaacgctgctgcacgtatgaacggtctttcttacagccgtttaatgcacggtcttaagctttcaggcatcgaagtaaaccgcaaaatgcttgctgatcttgctgtaaacgatcttactgctttcaatcagcttgctgatgctgctaaagctcagttagacaagtaagttgaaaaagccgctctctttccgggagcggtttttttacgtaaagggtgacaatcaatggctctcttcatttacgccgtattgataaacggatacggcttttggatcatgggcgctgataaaagaagagcaaaggcgcacaggtggagaatatcagagaaacgaatatggctcacagccgccatgttcggctcactcggcgtatggatcggcatgcgcaccttcaggcataagacgaagcacaaatcctttttatacggggtgccgctgctttttctcactgaagccgcccttgtgctcatgtatttgatgtataaaaaataaaaagcaggagagcttatcgctcgcctgcttttttcgcttttttgatgggctggtcccaatcaatcttgcaattcggataccgctccaatacctttttttcgacttcttcaaaatcatctgcagaaaagcggttcagcttttccggattttcggtccatacaaatattgtatggataaacagcggatgatctttggaagggatatgcttttctccttcaaagagcactcctttataagtaagctggagattttttcgcgtgtttttctgttcgtcaataaaataaaaattctcttttgattgcgccagtctgagccttcttttcgggtttgcgtaaaatttgacgcacatgtaaataaaataaataagaagtgcaagcaagacaatcctcaatactgtaatggccatatgtgtgaaggcacctcctcacctttgtcatgatctgatgtaatacgaaaaacaaaacaaaaagtttcatttttttaaaagaaatagataaaaacatttacccgtttttcaggcgaattaatcgtatgcttcagcattggttttgtataataagaagggtagtgaaaaaaaggaggtttattgatgacaaaattagatgaaacgctcaccatgctgaaagcgttaacggatgcaaaagggataccgggaaatgagagagaagtaagacaagtgatgaaatcatacatagaaccatttgccgatgatgtcacaacagaccggctgggaagtttaatcgccaaaaaaaccggcaaagaaaacggtccgaaaatcatgatctcagggcatttagacgaagtcggttttatggtgacgcaaatcactgataaaggctttctccgctttcaaaccgtcggcggctggtggtctcaggtcatgctggcccagcgcgtcaccgtcgtgacaaaaaaaggggacatcacggggatcatcggttcgaaaccgcctcacattctgcctcctgacgccagaaaaaaagccgctgatattaaagagatgttcatcgatatcggggcgtccagccgtgaagaagcaatggaatggggcgttcttccgggtgatcagattgtgccgtattttgaatttacagtgatgaacaatgaaaagcatttattggcgaaagcgtgggacaaccgtatcggctgtgcgattgccatcgatgtattaaaaaatctgaaaaacagtgatcacccgaatgaagtatacggggtcggaacggttcaagaagaagtcgggctgcgcggggcgaaaacagcggcacatacgatccagcctgatatcgcgttcggtgtggatgtcggaattgccggagatacaccgggaatttctgaaaaagaggcgcaaagcaaaatcggcgaagggccgcaaattattctgtatgacgcgtcaatggtatctcacaaagggctgcgcgaccttgtcgtaaacacggcggaagaagcgggaattccgtatcaattcgattccattgccggagggggcacggattcaggttctattcatttaaccgcaaacggagtgccggcgctgtccattacgatcgcgacgcgctacattcacactcatgccgctattttgcatcgggatgattatgagaatacggtaaaattgatcacagaagtaattaaaaaattagaccgggaaacggttgaccgtattacttatcaataaagatacggaagaatctgcttttttaagcagattctttttttttgtctgtacaaatatgagccttgcgtctacaataagaaaagacatagaaaaatctgacaacatgtttttgaaagcgctttaaaaaaagggaggtttacaaatgaaaaacagattcagacgcatgatccgcttttcatgcgcagtcgttacagccggtctgcttctgatgtcttcatctccggcatctgccgcgttttggggggcatcaaatgaattgcttcacgatccgacaatggcgaaggaaggaaacacgtggtacgctttcggaaccggtttggaaggggagagggggcttcgcgtcttaaaggcgggcagcggcggcgtatggaccgttcagaaatcaatctttacttccccgctgtcatggtggggcaattatgtgccgaattacgggctgaatcaatgggcccccgatgttcaatattttaacggaaagtattggctgtattatgccgtttcttcattcggcaaaaatacctccgcgatcggtcttgcatcatctacaagcctcagttcgggaaactggaaggacgaagggcttgtcatccgttcgacaagcgccaataactacaatgcaattgatccggagctgacaattgataaagacggaaacccttggcttgccttcggttctttttggagcggcattaagctgacaaagcttgataaaaatacaatgaaaccgacgggatcactttattccatcgctgccagaccgaataacggcggagctttggaagcgccggccatcacctaccagaacggctactattacttaatggtgtcgtttgataaatgctgttcaggggtgaatagtacgtacaaaatcgcttatggaagatccaaaagcatcaccggcccatatctcgataaaagcgggaaaagcatgtctgaaggcggagggacgattcttgattccggcaatgaccgctggaaaggcccgggcggtcaagacattgtgaacgggaatattttagtgcgtcatgcgtatgatgccgaaaacagcggaattccgaagatgctcatcaatgatatcgattggagttcaggctggccttcctattaattgatcagccgggcatgtgtgtccggcttttttacttgcaataaaagattgacagtttgattcctccttaactataataaagttgttcgtacaaataaaagaataaaagttttattatttatattcgtacgtatatttatttaaaaatgcaagcgctttattttgatgggaaggggaaatgaatgtgcttcagaacaaagaatatgaattttggtttgtaacgggaagccagcacttatacggagaggaaacgctgcagcttgtcgataaacacgcaaagggaatatgtgacggtctcagcggggtgtcatcaagatacaagatcaggcataaaccggttgtcacgtcatctgaaacgatcagagaggttttgcgggaagcgcagtatcaagaaaactgtgccggggtcgtgacgtggatgcatacattttcccctgcgaaaatgtggattgaaggtctttccgcttttcaaaagccgatgcttcatctgcatacccagtatcatcgcgacatcccgtgggaaacgattgatatggactttatgaacagcaaccaatccgctcacggagaccgggagtacggatatatccagtcaagaatggggcagacgagaaaagtcatcgcaggctattgggatgatgaggaagtcaaacatgacatttcgcaatggatgaacacggctgccgcttggaatgaaagcaggaatattaaagtagcccggttcggcgacaatatgcggaatgtggcggttactgacggagacaaagtcggcgcccacattcaattcggctggcaggttgacgggtacggaatcggcgatcttaccgaggtgatgaacaatgtcaccgacgcagaaattgaggcgctttatgaggaatacgacaaattgtatgtcatcagcgacgaaacgaagcgggatgaagcaaaagttgcttccattaaagaacaggcgaaaattgaactcggattaacggcctttctcgaacggggcggatatacagcgttttcgacctcctttgaagttttgcacggaatgaagcagcttccgggtcttgccgttcagcgtctcatggaaaaagggtacggatttgccggcgaaggcgattggaaaacggctgcccttgtgcgaatgatgaaaataatggcggacggagaacaaacctccttcatggaagattatacgtaccattttgaaccgggtcgtgcgatgattctcggatcacatatgcttgaagtatgtccgacgatcgcccttgatcagccgaaaatcgaagtccatccgctctcaatcggagggaaggaagatccggcccggctggtttttaacggaatcggcggttcagccatcatcgccagcatcattgatatcggcgggcggttccgtctcattctgaatgaagcggaaggcagggaaattgatcatgatatgccgaatctccctgtggcgcgggtgctgtggaagccggagccatcgctgaaaacagctgcggaagcatggattctggcgggaggcgcccaccatacctgtatgtccttccggcttacggctgaacagatgcttgactgggctgagatggcaggcattgaaagcatctttatttcccgcaatactgaaatacatgagctgaaaaaagagctgaaatggaatgacgtattataccggctgggagggaattgatatggcgtatacgattggtgttgatttcggcacattgtccggccgggcggtgcttgtcaatgtccgcacgggcgaagaaatcgcgtctgcggtaaaagaatacactcatgccgtcatcgaccgcacgctgccgaagacgggtgaaaaactccctcgggactgggcgcttcagcatcctgccgattatatcgaagttctggaaacggcgattccgaacctgcttgagcaggcgggcgctgatccaaaagacgtgatcggcataggaattgatttcaccgcctgcacgattttaccgatagacggcgcggggcagccgctttgtatgctgccggaatttgaacgggagccccacagttatgtgaagctgtggaagcatcatgcggctcaaaaacatgcagaccgtttgaacacgattgccgaagacacaaaagaaacattccttaaaagatacggcggtaaaatttcttctgaatggatgatcccgaaaatcatgcaaatcgcggaagaagcgccgcatatatacaaggcggcagatcggattgtggaagcggcagactggatcgtctatcaattgtgcggttcattgaagcgaagcaactgcacggccggctacaaagcaatctggaatgaggagacggggtatccgccggatcattttttcgaaaagctcaacccgttaatgaaaacgattacacaggataaattaagcggcgcgatttattcagtcggggaaaaagcaggaggtttgaccgaaaaaatggcggagctgaccgggcttctgccggggacggccgttgccgtcgccaatgtcgacgctcatgtgtcagtgcccgcggtcggtattacagagccggggaaaatgctgatgatcatgggaacgtctacctgccatgtgctgctcggcgaggaagaacatatcgtccccggtatgtgcggggtcgtcaataacggcattttgcccggatatgcgggatatgaagcggggcagtcctgtgtcggcgaccactttgaatggttcgtcaaaacgtgcgttccgagagactatgagaaggaagctgaggataaacacatagacattcacgagctgctcagcaaaaaagcagcagaacttgttcccggggaaagcggccttctcgcgcttgactggtggaacggaaaccggtcaaccttggtggacgccgatttgacgggcatgatgctcggcatgacgctgcacacgaagcccgaagaaatctacagggcattgattgaagcgacggcgttcggaacgaggatgattatcgaaacgttccgggaaaacggcgttccggtcgaggagctttacgcagccggaggaatcgccgaaaaaaatccgtttgtcatgcagatttacgcagacgtcacaaatatggacattcaattatccggatctccgcaggcgcctgcactgggctccgcgattttcggagcgctcgccgcgggacgggaaaacggaggattctccaatattgctgaagcttgcgcgcatatggggaaattaaaagacggcttttatgccccgaaccgggaaagagctgagatttatgacagcttatatgcggaatataaagagctcgtacactacttcggcaaagaaaacaatgtcatgaaacgcctgaaagccattaaaaaccgtgattttgcgaaaggggggagccgccatgcttgaagcgttaaaagaagaagtgctcgccgccaatctgaagcttgaggaacataaccttgtcacgtttacatgggggaatgtcagcggcattgacagagagagcgggagaatcgtcattaaaccgagcggtgtcgattacagtgagctgaccgctgacaagctggtcgtcctgaatgaggacggagacattttggaaggctcgctgaaaccgtcttctgacacgccgacccatctttatctgtataaagcgtttccggctatcggcggaatcgttcatactcactcccgctgggcgacgagctgggcgcagtccggaagagacatacccgctctcggaacgactcacgcggattactttgaaagcgctataccctgcacgagggaaatgtatgaagaagaaattgtgaaagattacgagtatcatacaggcaaagttatagccgaaacctttcaaaacgaaccgtatgaacaaaatccgggtgtcctcgtccacagccacggcccgttctgctggggaacggacgcgctgaatgccctgcataacgccgttgtgctcgaaacggtagcggaaatggcctaccattcgcttatgctgaacaaacagctcagtccgatcgacagagtgctgcatgataagcatttttacagaaaacacggggcgaatgcttattatggccaaacttgacgcagccgggtttctgattgatttagacggaaccgtattcagggggcgggagctgattgacggcgcaaaagaagccgttcatacccttcagtcactgggcaaagccgttgtctttttaagcaaccgcggcaatctatcaaaagcaatgtgcagaaagaaactgctgggtgccggtatccgcacggatgaacggagcatcgtgctgtcctccagtgtgacggcatcatttttaaagaagcattatcctttgtcaaaggtctgggtgttaggagagaaagggctgactgatgaactcgctttagcgggtgtcgtcctggcgcaaaacccgcaggcggcagactggcttgtcatctccctgcatgaaaccgtcacctataaggatctgaatctcgcttttaaggcggcttcctccggcgcgcgcatcatcgccacgaacaaagaccgctcctttccgaatgaaggcggtcatgccatggatgtcgcgggaatgatcggggccattgaagcatccgccggagcaaaaacggagcttgtcatcggcaaaccgtcttggctgatggctgaggcggcatgtgaagcgctcggacttccccctgaggaatgcgccataatcggagacagcctcgaatctgatatcgcaatgggcaggctgtacggaatgaaaagcatattggttctgacggggtcggccaaacttggggagccccgtctatatgaacctgacatcgtccttgattctattaaagacctgacagaattagcgaaggagggaatccttttatgaaacgttctcctgaggacattcaatccgagtttgacaaggaaggggccagccgctcaccgattcaaatagaagatatcgtgatcggggcgaatgcaaaagaagagcttctcagatttctgcaaaaaaaatgctggaatcatccggtcatcgtctgtgaccggaacacgtacgaggcggcgggacgtctgcttgcggacgaattaagggcaggcggaatcaaagcgtcaaaagtcatcattccggagcatgaagccggggccgccgcggctgatgagaggacattggtctatacgctgatcaatctcgcggaagagacggatgttatcatagcggccggttcaggaacgattcacgacattacgcggtttgccgcttatcagcgcggattgccgtttatctcattccccaccgctccgtcagtcgacggttttacatcggcgggagcgccgctcatattaaacggaatcaaaacgacgattcaaacgaaagcgcccatcgccttatttgccgatacgaatgtattaaaagaagcgccccgttcaatgacagccgcgggcttcggagacatgctcgggaaaataacatcgctggctgattgggagatttcccgcaggcttgcgggtgagccgtactcagaagccggggcgaagcttgtgaaagacgcgctttggcagtgcattgatcaccgcgctgacattgccatgggaacggaggccggcattcagatactgatggaagcgctgatcgtttcgggtcttgtcatgcttgctcttgaccactcccgccccgcctcaggaggagagcatcacatctcgcattggattgagatggaaatgctgaaggcaaaacagcctccgattctccacggtgcgaaggtcggctgtgcgtgcgcggtgctgagtgatatttacaaagaactggcttgtcacgaaaagcttgctgaactgccgccgcactttcgcgaggcgattcagtccgcatatgaagggcttcccgacggcaaaacaattgccgggtggctctcatctgcgggaggtcccgcctgtttcgatgagatcggtgtaaaaaaggaccttgtcagcgatgcgcttaagcatgcgcacacactgcgagaccgttataccggtttaaccatcataaatgaaaatgcagcgctctttgcacatcatttgcatcaatagccgcacggcctaaagtggaaggggtaatgacatgaaaaaaacgaccgctgtatgtttggtgctgatgatgctcttcttgtttaccgccggctgttcacaagaacggactgccggccggccgggagaaacggagctgacgttttggacgtttaacggtctgcacgaacagttttatcaggaaatggtcaaagaatggaatcagaagtatccggatcgcaaaatcaagctgaataccgttgtttatccttatggacaaatgcatgataatttatcggtttcgctgatcgcgggtgaggggcttcccgatatagccgacgtggaattaagccggttctcgaactttctgaaggggaaggatatcccgcttgccgatctgacgccgctgattgaaaaagaccgcgataagtttgtggaagcgcgtctggccttatacagcaaaaacggaaaattgtacggccttgatacacatgtggggacgaccgtcatgttttacaacatggatatcatgaaaaaagcgggcgttgatcccgcctccattaagacatgggaagattaccggcgggcaggaaaaaaagtgcgtgaagccgctgggaaaccgatgggaacggttgaaacaaacgactccgccacattcctatccatgatttcgcagcaagggtcaggctactacagcaaaaacggaaaattgattctgaacagcaagacgaatacagatacactgaatgatgtaaaggacatggtaaatgataaaacccttctgccggctcccggcggcggccatcacagcgaagaatactacggttttatgaatcagggcggggcagcctcagtgctgatgcccatttggtacatgggacggtttatcgattatatgcctgatttaaaagggaaaatggcgatttaccctatgccggcctggaaagaaggcggtgacagatcagcgggtttaggcggaacagccaccgtcgtgccgaagcaggctgaacatctggagctcgcgaaagaatttctcggatttgcgaaaggttcaaaggaagggaacataaagctgtggacggtgctcggctttgacccgctccgctgggacgtgtgggattcaaaagaattgaaggagaaaaacaagtacacggatttcttccggaacggtacgtcaattttttcctcgctccttgaaataaaagatgagatcaatccgatttatctgcatgaagacttctctaaagcggctgatctcgttgtcagacaggtgctgttcgatgcgctgaagacgcaggaaaaaacacctgaggaagccttggacgaggcggcagagcaattagaaaaataggagaagccgccctatttaacagtgaaagcgggggagcttttatgagacctgtaaagacagagacagcgcaaaccgtttctgcagtccggaagaagccgcgccggcgcaatgtgctgtattcaaaaaaagcggcgccttatctttttacggcgccatttatcatttcgtttctcgttttctttttgtatccgatcatcagcgtgtttatcatgagctttcagcggatactgccgggagaaattacatttgtcgggttttccaattataccgctcttcttaatccaaccttttatacggcattatttaacacattggaatatactttctggacgctgatcgtgctgattccggtgccgcttcttttagcggtgattctgaattcgaagctcgtcaggttcagaaatgtgtttaaatcggctctgtttgtaccggctttaacatcgacgatcgtagcggggattattttccggctgatgttcggagaaatgaatacgtcgcttgcaaacgagctgatgatgaagcttggcgcatcaccccaaaactggctcaacaacaaaggtaccggcatgtttttaatggtgctgcttgcgtcatggaggtggatggggattaacattctttactttctggcgggtttgcaaaatgtgccgaaagaattgtatgaggcggctgaaattgacggggcgagtacgtggaaaaagttccggcatatcacccttccatttttaaagccggtgtccgtttatgtgttaacgatcagtatgatcggcggtttcagaatgtttgaggaaagctatgtgctttggcagaataattccccgggcaatatcggcctcacgcttgtcggttatttatatcagcaggggcttgcatacaacgaaatggggtacggggcagcaatcggaattgtccttttgcttgtcatcttactagtcagccttgtttcactgaaactgtccggttcgtttaaaggggagggataagcgttgcgtaacaatcacatgttttccgtgtacagagtcgcgtttaccttgttttttatcatgctgagcctgttgtatatctttccgatgatctgtctattgctcggttcattaaagccgtcatctgagctgatgcgcatcgggctgaatctgcgtcttgatccggatgtgatgagccttgataactacacctatttgttcaacggggggagcatttattttaaatggttttttaacagcctgctgctcggcgtcctcaccacggttctcacgctgtttttttcctctttgatcggctacggactcggtgtctacgagtttaaaggcagaaatattattttcgttcttgtgctgatcattatgatggtgcctcttgaagtgatgatgctcccgttgttcaaattgacggtgggtcttcatttaatcgattcttatacgggggtgattctgccgtttattgtgtcgcctgtcgccgtgttctttttccggcaatatgcgctcggacttccgaaggatcttcttgattcagcgagaatggacggctgcaccgaattcggcattttcttcagaattatggcgccgctcatgaaaccggcattcggagcaatgatcattcttcaatctttaaacagctggaataactttttatggccgctgatcgtgcttcggtcgaaagaaatgtttacgcttccaatcggactttcagggctgctgagtccgtacggcaacaactatgacatgctgatttccgggtccgtttttgcgatactgccggtgatcatcatattcttgttttttcaaaaatacttcatttccggcctcacagtaggcggagtgaagggatagagagagggaggaaatgtaatgaaaaaagcggggattacagcagataaagaatatatcatcggtgaagtggacaaacggatgtacggatcttttatagaacatatgggccgggcggtgtatgaaggcatttatgagcccggacacccgaaagccgacaaggacggtttcagaacagacgtgcaggagttaatcaaggaattgcaagtgccgttcatccgctatccgggagggaattttctctcaggctacaattgggaggacggcgtcgggccggtgaagaaccgcccgcggaggcttgatttggcatggcagacgacagaaacgaacgaagtggggacgaatgaatttttaacgtgggcgaaaaaagtgaacgccgaagtgaatatggcggtcaatctcgggacgagaggaatcgatgccgcccggaacctcgtcgaatactgcaaccatcctgaagggtcatactggagcgacttacgaaaatcgcacggatatgaaaaaccttacggcatcaaaacatggtgcttaggaaatgagatggacggcccttggcagatcggtcataaaacggcgcatgaatacggacggcttgccgctgaaacagcaaaggtgatgaaatggacggacccgacgatcgaattggtggcttgcggaagctcaaacagcggcatgccgtccttcatcgagtgggaggccgaggtgcttgagcatacgtacgagcatgtggattacatttcactgcatacgtattacggcaaccatgaaaatgatcttgagaactatttggcgaagtctatggatttagaccattttattaaatccgtcacagccgtatgtgattatatgaaagcgaaaaaacgcagcaaaaaaacgattcacctttctttagatgaatggaatgtgtggtatcactcaaatgaagcggataaaaaagtggagccatggattacggcccggccgattctcgaagacatctacaattttgaagatgcgctgttgatcggttcactgctgattacgatgctgcagcatgcggacagactgaagatcgcctgtctcgcccagcttgtcaacgtgattgcgcctatcatgactgaaaagggcggagaagcatggaggcagccgatcttttacccttacatgcacgcctcagtctacgggagagggacttcgatgaagctgctgatcacctccccgaaatacgactcggcggactttacggatgtgccgtatgttgatgccgcggccgtttaccatgaagaggatgaagcactgaccatttttgccgtcaacaaaagcaaggaaccgatggaaacggagatcaaactgagggggtttgaagattaccgcatcattgagcatatcgtgctggagcatcaggatatgaaagcaaccaatcaaaaaaacagaaaagaagtcattcctcactccaacggaacgtcttcggcaaacgctgaagggataacggcacattttactccgctgtcctggaatgtcatccgtttatcaggaaaataatgttccgaaaagccgggctgccgctgccggcttttttttacgcaaaaatcatctcctgttatctgataattatgataatatttagaaaaagagaaaaggggctgggattaaatgaatgcgattacaatcgtcatagcgtctatatgtattttggcgatcgcctatcggctttacggtacctttatgatggtcaaagtattaaaaatcaatgatcagacaccgactccggcccatgtgcttgaggatgggaaagattatgtgcccacgaataagtgggtgtcattcggccaccacttcgcggcaatcgccgctgccggcccgcttgtcggaccgattctggcagctcagtttggctatctgcccgggcttttatggctgttaatcggagcggtgatcgggggagccgtgcacgatattgtcgtattgtttgcatcaatgcggaaaaacgggaaaacgctttctgaagtcgccaaagaagagctcggcccggtggcgggcttttgcaccggtctttccatgctgtttatcattacgatcacgatggcgggtctgtccatggttgtgctgcacgcgcttgagaaaaacccgtggggaacgtttgcggtggggattacgattccgatcgcgatgggggtcggcctctactataaaaaaacgggcaatctcaaactcgcatcaactgtcgggtttcttttgttaatggccggtgttgtaatcgggccgcggctgcagacaacggctctcggggacatgctgacacttgatgcgaaaacgcttgcagtggcgcttcccgtctatgcgtttttcgccgcggcgcttccggtttggcttttgctggctccgcgtgactatttaagcagttttatgaaaatcggggtttttgccgctttgatcgcaggcgtctttttcgtcaatcccgccattaaattcccggccgtaacggagtttattcacggcggagggccggtgatcgcgggtcctgtctggccgtttatttcaataacgattgcctgcggcgccatttcgggctttcatgcatttgtcggttctggcacaacgccgaaaatgctggataaatggagtgatataaaaccggttgctttcggagcgatgcttgtggaatgtctcgtcggaattatggcgctcattgcagctgccgctcttgagcccgccgactattttgccattaacagcacgcctgaaatattccgcgccctcgggatgaatgtcgtccatctgcctgaattgagtaaagaaatcgggctcagtctggaaggaagaacgggcggagccgttacgcttgccgtcggaatgacgtatatctttacggagattccgtttttcagtcatttggcttcatacttttttcaattcgtcattatgtttgaagcggtgtttattttaacggcgattgatgcgggaacccgtgtcgcccggtacttgattcaagagtttttcggagaggtctataagccgctgaaaaaaacagactggctgccgggctcgattttctcaagcgcgctcgcctgcctgctgtggggctatcttctgtattcgggcgacatcagttccatttgggcgctgttcggcgtatccaatcagcttatggcatctgtcggcttaatcatcggtgcgaccgtcgtattaaaaatagcggataagcggcgctatatgctgacatgcctgattcctctcgcttatttgtacgtgaccgtcaactatgcgggttattggatggtgcggtatgtgtatttgaaccccgaagcggcgggatacaacgtgctgaatggcgttttatccattatcatgctgattctcgggcttgtgattatcattgcggctgtgaaaaaatgggcgaatgtatggcgtgatccgagtgccagactggaagcttcaatacccggataaatccgcggccgatccgaacattgtagcatcataaaggcagagagccgatcggtctctctgctttcggcttatgacaaatccgccgcttccaaaaggtaatccgccaaatgaaccgcgcggacacggcctgttaatccttcgcgtaaaatgccgagctgcatttgcagaaggcatccgggattggctgtcacgatgacggccgcctccgtttttccggcggctttcatcttgctgtctaatattttcatagacatttctgactctgttatattataaattcccgccgacccgcagcagctgtcggccttttccatttctctgtactcagcccctttaatgtttttcaaaagcgtgcgcggttcttctgacgtatgcatcacattgcggagatggcaggagtcctgatatgtgacgatatgaggagactgcgcccgcaggtttttttgatggaacttcagatcaaccagtacggatgaaaagtctttgagcttccggacgaattgttcggcacgttccgcccatccaggttcatctttcagtaaatgcggatattcctgaagaaaggcgccgcatccgccggcgtttgtaatgatataatcagcgtcaagcgcctcaaaagcggcgatattccgcttggccagttcttttcccatctctttttctccgctgtgcccgtgaagcgcgccgcagcacgcctggccgtccggaaccgcgatttcacacccggccgcctgtaaaagcgccgttgtcgcatgatttgttgctaaaaacatcgtatccattaagcagcccgagaaaaaagcggcccgtttttggacgggacccgcggcaggaagaaaacgcggcctttccttcatgtctttccgtttcggggcgggcgggagcacttgttccattgtgcgcagatgttcaggcaaaacgcgcagcataccggtttttctgatggcggtctgcagtcccgatctttggtatattccgagaagattcacggctgcctgcatgcggttttgatgagggaaaagcccggtgaaggcggctttccgcaagaggcgcacgccgggcttatgttttttattttgatgaatgatatccctcgcttcttcaagcagctgtccgtaattgacccctgccggacaaacgggctcgcatgcccggcatccgagacacagcgaaagtgagcgctcgacatcttcatccggttcgatcagtccgtctgtgacggctttcatcagggcgatccggccgcgcggcgaatgggattcttgaaatcctgattcgatataggtcggacaggaaggaaggcagaagccgcagcgcatacagttcagcaattcaccttcatccatgcggtttttgaattctgtttgaatgtgttgctgctctttagccgttgtcatttcatcatcaccacgcgtttccttgatgaattggcgaatatttttcccggattcagcagattttggggatcaagcgcttgtttgatcgctttcatggcggtaatgccttctgttttcagcttcatttctaaatacggcgcttttacgatgccgaccccgtgttcacccgttatcgtcccgcccagctcaatcgctttttcaaaaatggcggcaaaagctttttcgacacgttccatctcctctgtatttcggatatcggtggtgcacgtcggatggaggttgccgtctccggcatggccgaatgtgcagatggacaggccgtatgtttctgcaatctcgttaatggctttgaccatgccggcaatttgtgatctcggcacggtcgcgtcttccagaatcgtcgtcggtttcagccgggcaagggctgataatgcggaccgtctggcctctgtaagcgcgaatgcctcttcctcggtttcggccgtttggacggatacggctgctccgtttttacagatggcttcgattttttccatatctcgtctgaccgtttcgatgtcaccgtcctgttcgatcagcagcaccgcttttgcatcggtcggaagcccgatcttggcgtaatcttcaatgacctgcagtgtcggctgatccagaaattcgagtgtcgccggaatgattttttcagcgatgatggcagaaacagattccgcagccgcttcaatatgttcatagagtgcaagcagcgtttttttcgtttccggcttcggaaccagctttaaagtcgcttccgtcacaacgccgagcgtaccttctgatccgacgaaaagccgggtcagatcataaccggcgacatcctttgtcagcttccctcctgtgcggatgatatcgcctgaagccaagacggcttcaaggccgaggacataatcccgggtgacgccgtacttcaaaccgcgcagcccgccggaattttcattaatattcccgccgatcgtcgatattttcatgctgctcggatcaggcggataaaataaccctttcctttcaaccgcatgaatcatatcttgcgtgatcacgcccggctggacggttgccgtcaaattttcttcatcgatttcaagaatgcggttcatatgtttgaataaaagcacaagcccgccttcagacggacatgtgccgccgcataagtttgtgcctgaacccctcggcacgatcggaatgtcatgcctgctgcaaatcgttaatatacgggacacgtcatccgcgctgcggggagcgattaccgcatccggcatggcttgcagctgaggagccgcatcgtaagaatacacaagacggccagccgccgaatcatcataattctccttcccgaccgtccggatgaacgcttcttttgcctctcgtgaaatcatgttctccaacctccctgataagaaaagcgttttcatttaattgtaaagaaaaacgattcttcacactatggagaaacatatgaaaaatgatgatatgattacgtgctttttgtatgttgatctaaaaagcggagcgccaaataaaaagccgttatgtcttcggggcggtcaagcttcatatttgtcagtgattccagtttggaaagacggtagcgcaatgtattgatatgaatatgcatgtcgtctgcggtgcgctttaacgataattgccggtcgaaaaaggcgcgcagcgtatccagaagttcttcccggccgagtacatgctcgagaacccgccgtgaaaattccgacctcgtgccgggcgcgatatcggcaatacacatatccagttttaaatcttcttcaaagacggcctgcttgtcaccgattccggctgaaagtgctttatccgcctgttcgtatgattccgcgaggcgctctcccggaacgatccgtccgatgccggcggtgacaggctgcccaaaaacggcgccgatctttttgatgagctgtgttttggaagccgaatttgcttcatggttaatgagaatgcgttcatttccccagcggacaaacaggtcttcagggcattcgttctgccagagccgcccgagctcctccgctttatattgctcataacgtccttgaatgagtatgatccggcggtatgcgtgaaggtctgcgccgatgagctttgctttttctaaaaagcccggagaccattctttcagctgcagccaatcaaccataaaggattcaagcattctcgcacgccactgcgcttcttccatatggcgcgtttctttaataaacagctccgtcattttcctgagcaattctccgaaaggcaggatatcgtcagggtctcctgtcagaccgaacactccgattacctcatggcctgaaaaaacggggaggttcagtcctgcttttacgccctggaggcgtttttcatcttctttcgtaatgatgacattccgtttttcgcgggcgcagatcagtgcgccttcatgaaaccatccggcgcgcgcctcattggtgcccgcgatgatcatcccttttgtatcggcaataatcacttcgcggctgtacatatgtttgacttcggcaatcaatttctttgccagttccggctgtaactgcatggcgatccccctcgccattattatacaaaaaaaaccgggtgtgccatcacccggttcatgcttattgcgcaggttttaatccgccttcaagtgttttgagcatttcatttttttctgagtctgacgcatgctgccaaagaacttcgaataagacgccgaggcccggaagcattttttcttcaccgctttggatggcgtcaacgatagtatgctccagctgatcctggttattgccggttacattggcaataacggcgttgcgtaaattaagatccattacaaccgctcctttttcctgaatgtgatacgcatattcttaccgcgcacgcggtttattatgtgctgttcttgagatataataacaacatgcatgaaaaaaggagagcacagacataaagtgaaacgaatcgactctgcaaaaaaccaaaaagtgaaggactggaaaaaacttcacacaaaaaaagagagacttaaaacgaatacatttctgatagaaggagagcatctggcagaagaagcgctcaaatcaaagggaacggtaaaagaaattctcgtaaacgatgagagcgccattccggccgatctggatatgagcattccgtgctacgtgctgagcgaagacgcgttttcagccgtgacggaaacggaaacgccgcagcggatcgccgcggtctgccatatgccggataagcggcctgatcagctgaagcggctgcttctgattgatgccgtacaggacccggggaatttaggaacaatgatcagaacggcagatgcggcgggaatcgacgccgttgtccttggtgagggaacggcagacccgtacaacggaaaaacgctgcgttcagcgcaaggatctcattttcatattcccattttaaaacgtccgcttgatgagtttaccgccgagctgaaatcacaaggcgtcgcgatctacggcacggcgcttgaaaacggtgcggcttatcaaagcgtgaagcctgaagaatcgttcgcgttaatcgtcgggaacgagggggcgggagtggacgccggccttctgcaaaaaaccgatctcaatctgtacgttccgctgtacggacaggcggaatcgctgaatgtggcggtagcggccgccatcctcgtttatcatctcagaggataggttgcgaaaaaccttggatttcactataatagatagcaataatgtaaaaaccgtgacagaggacgtcaatttttgcacacgctgccttccagggagaaaatgccgctgactgagagcatttttatcgcagcacagaaattgattttcacctctcgagttgtcaccgggaccgcgccaaacgcgcgtaaaggtgaaccggaacgatcgtttccgttatgtcaatgaagctgtcggcagatgaagtctgccttaaaaagggtggtaccgcggccacaactcgtcccttctctcaaggggcgggtttttttgttttctgaaaaaggcatagaacggtttggtttacataaaaggaggatgcatgatggaagagaagcttaaacagctcgaactggaagctgcagaaaaagtagaagcggcgggttcattaaaagaagttaacgacattcgggtgcaatatctcggaaaaaaagggccgattacagaagttctccgcggcatgggcaaactgtccgccgaagagcgcccgaaaatgggagcgctcgccaatgaagtgagagagcgcattgcagcagccattacggcgaaaaatgaacagcttgaacaagaagagatgaataaaaaactcagcagccagacgattgacgtcacgttgccgggcagtcaggtaaacatcgggggacgccatccgctgacggtcgttattgaagaaattgaagatttatttatcggcatgggatataccgtcgaagaaggccctgaagtggaaacggattattacaactttgaggcgctgaacctgccgaaggaacatccggcccgcgacatgcaggacagcttttacattacagaagaaatgctgatgagaacgcagacgtcaccggtgcagacgcgaacgatggaaaagcataaaggaaaaggccccgtcaaaatcatttgtcccggtaaagtgtatcgccgcgacaacgatgacgcgacacattcccatcagttcatgcagatcgagggtctcgtcgtggaccgcaaaatcagcatgagcgacctgaaaggcacgcttgaattggtcgccaaaaaaatgttcggccaagaccgtgaaatcaggctccgtccgagctttttcccgttcacagagccttctgtcgaggtggatgtgacctgctttaagtgcggcggacaaggctgctccgtctgcaaaaaaacaggctggatcgaaattctcggcgccggcatggttcacccgaacgtgctgaagatggccggattcaatcctgaggaataccagggttttgctttcggaatgggtgtggaacgtatcgcgatgctgaaatacggcattgaagatatccgccatttctataccaatgatgtcagattcatttcgcagtttaaacaggcgtaagaggaggatacacatgtttgtttcatataaatggttagaagattacgttgacttgcagggaatcgacccggccgtgcttgcagaaaaaattacgagagccggtattgaagttgagggtatcgagtataaaggggagggcgtaaaaggcgttgtcatcggacacgtgcttgagcgtgaacagcatccgaatgccgacaaactcaacaaatgccttgttgatatcggtgcggaggaacccgtgcagattatctgcggcgccccgaatgttgataaaggacagaaggttgccgttgcaacggtcggagccgtgcttcccggcaatttcaaaattaaaaaagccaagctgcgcggcgaagcgtctcacggcatgatctgttcccttcaggagctcggcattgaaagcaagctcgtggcgaaagaatatgcggaaggcattttcgtttttccgaatgatgctgaaacgggagctgacgcaatggcggcccttcagcttgatgatgcgattttagaattcggcttaacgccgaaccgcgccgacgcgatgaacatgcttggcgtggcttatgaagtggcggctatcctcggcgcagaggtaaagcttccggaggcttcatatgaaaaagcggcagaaaaagcggcggatgctgtttccgtcaagattgaagatacgcaggccaatccgcattatgccgcaaaaatcattaaaaacgtcaaaatcggcccgtcaccgctttggatgcagacgaagctgatgaatgcaggcatccgcccgcataataacgtcgtggacattacaaacttcgtcctccttgagtacggacagccgcttcacgctttcgattacgaccggttcggttcaaaagaggtcgtcgtcagaaaagcggcggaaaacgaaaccatcgtgacgctggatgaacaagagcgcaagctgtcaagcagccatttggtcatcacaaacggaaaaaaagcgcaagccgttgcgggagtcatgggcggagccgagtctgaagtccgtgaagacaccactgcgattttactggaagccgcttatttcgacggacagaccgtccgcaaagcgtcgagagacctcggactgagaagcgaagcgagcgccagatatgaaaaaggcattgatccggcccgcgttttgctggcggctgaacgggcctgcagtctcattcaggcatatgccggcggagaagtgctctcaggcacggttgaagaaaaccatctgaaaatcgaagcaaacaacattcacgtgtctgttgaaaaagtgaacgccgtgcttggcatggcaatcgctaaagaagaaatcatcagcatttacaagcgcctcgggtttgcagtcagtgaagctgaagacgttctcgtcgtaacagtgccgtcccgccgcggagatattagaatagaagaagacctgattgaagaagcggcgagattgtacgggtatgacaatattccgtccacgcttccggaaacggccggcacgacaggcggcttgacaccgtatcaggcaaaacgccggaaagtgagacgtttccttgaaggagcgggtctttcacaagcgaccacttattcattaacgaatgataaaaaagcggccgcttttgcgatcgaaaaatcattcaacacgatgcttgctctgccgatgagcgaagaaagaagcattctcagacacagtctcgtgccgaatcttcttgaagccgtttcatacaatctggccagacagactgattccgttgctttatatgaaacgggttctgtatttctgacgaaagaagaaaacacaaaaccggttgaaaaagaacgggttgccggagctgtaaccggattgtggcgcaaaaatttatggcagggtgagaaaaagccggttgatttcttcgtcgccaaaggaatcgttgaaggcctgctgcatcaattgaatgtgtcagatcgggttgaatttgtccagtctgcacgcaaaaacatgcatcccggccggacggcaaacattctattgaacggttcgcttgccggatttatcggccaggtgcatccggcaatggaaaaagagctggatatcaaagaaacgtatgtgttcgagcttgatctgcacgcgcttctgaccgaggaaacagaacctgtcgtgtatacgccgattccgaagtacccgtccgtcacgcgcgacattgcgcttgtggcagataaaaccgttacaagcggacagctcgaagccgtgatcaaagaagccggcggcgcgctgctgaaagaagtcaccgtatttgatgtgtacgaaggtgagcatatggaagagggcaaaaaatccgtcgccttctcgctccaatatgttaaccctgaacaaacattgacagaagaagaagtgacaaaagtacatgaaaacgtgctgaaagcgctggaagaaacgtatcaggcggtattaagaggataaagaaaaagcttgcagatcattctgcaagctttttttattatgaccgtttccgttctacaaggcgtttcgctttttgcgtattggcaaaatgaagtttggtgaacgttctgagcgcaccttctcccttattgatgatcagcttggcggcagcttcatcgacgtgcggccccgcgccttttggaatcgtcatcccagcctcacgggaaagcttatccatttcaattaagaaagaatatcgcgcaatgatagaggctgcggcgacggaaagatgtatgctttccgctttcgtgctgaaaaacgttttttcttttacgatatcccgtccggaaagatgcttaaaataaatgccgggctctgcaaattggtcaatcagaatcgcttccggtttaacgccgttcatttttctcagcagattggaaatcgcctgattatgaaggagcgccttcatttttccttggctcatgcctttttcctgcatctgattgtatttttcgtttttcaacacaagcaggctgtaaggaatggttttaattaacagtttggcgatttcaataatctgcggatcttttaaatccttcgaatccttcacaccgagttctttcattaaagaaagctttgttttgtcggcgtaagcgcaggcaaccgttatcggcccgaagtaatcgcctgttccgacttcatcagagccgatcactgacatggaggcaatgcccgccgggggagcgtaaagcggatcggccgcttttttgacggttttctttgccttcggcgcctcagccgttccccagcgggccgcttctgtgccggcgttttttccctgaaagagaaccttgcccgagcggtaggctgtaatggtacagcccgggggcttggcctggaagacggcgccctgcggaacggcgggagtaagggagccggcataggattgtttcatttgttccatagcggaagcggatacttttataacagaatgggacacgatataatctccttttttggcacttttcactgtatataccagtgtatcataacagcccgaggcttgtctttccattcaaacgataatcgtggtatgataggaactaggattctcgcggaatggaggagaaacgttgtctgacggcaaaaaaaccaaaacgacagtaaacatttacggccagcacttcaccattatcggggaagaaagcaaagcgcacatgcgccatgtggccggaatggttgatgataaaatgagagaaatcaacgagaaaaatccatatcttgatataaataagctcgctgtattgactgcggtcaatgtcgtgcatgattatatgaaactgcaagaaaaatatgaaatactggagcggcagcttaaagaaaaggaatgaacaccatatgatagatatcatcatcttagttctgctcttaatgggcacattgcttggattaaaaagaggatttatcctccaatttatatacttgacgagtttcatcctctcgattgcgtttgcggcgcttttttacaaaaacctggccccgcatctgagctttatacccgcccctgatttttccggcgggcaggcggctctgtcttttattaaaggaaacgtggagacggcttattacaacgcgatcgcgtttgtcattttgtttatcatcgcaaagatcctgctccggattatcggagcggcgcttaatatcatcgccggcattccggtcattaaacagatcaacaaactgctgggcggggtgcttggatttctggaagtctatttatttgcgtttatcctgttatacgtcgcatccgtactgccggtaagcgtgcttcaggatatgctcgcacaatcgacgcttgcaaatatcatcacacatcatacgccgtatctgtcggggctcctgcaagaactgtgggcccagtacggggcataaaaaacttctcttgaccggagaagtttttttcaagctctgcgtcagttgtgccggaagagaaaaatttgtatgatgaaaagcaggaaacgactgggggttaacagtatgcataaaaaagatatcatcaggctgcttgaaacgattgcggtctatatggaactgaaaggggacaacccgtttaaaatatcagccttccgaaaagcggcggcggcgcttgagcaggatgaccgcagcctgtcggaaatcgacgacatgatgtctttatccggaatcggaaaaggcacctacggcgtcattcgtgaatatatgcaggaaggtgtgtccggcacgcttctccaattgcagaaagaagtcccggaaggcttggttcctcttttgaagcttccgggcctcggcggcaaaaaaatcgccaagctgtaccaggagcttggcgttcatgacgcggaatcgctgaaagaagcatgcgagcagcaaaaagtacaggggctcgccggtttcggcaaaaaaacggaggagaaaatccttcaggctctcggagaagccggaaaacagccggaacggtttccgatcggctatgcgctcagcattgcttcagtcattgaagaacatttggcccggctgacggatattcagaaatattcccgggccggcagtctcagaagagcgcgggaaaccgtaaaagatctggattacattatcgctacagatcgtccggaggctgtcagagaacagcttctttccctcccgaacgtaaaagacgtgatagcgggcggggatacaaaagtatcggttatcctgacctttgaatacgagacgagtgtggatttccggcttgtgacagaggaacagtttgccaccacactgcatcattttaccggttctaaagatcacaacattaaaatgcgtcagctggcgaaagagcgcggtgaacggatcagtgaatacggagtagaaaccatagaaacgggagacgtcaaaacattcccgagcgaagaagcgttttacgcccacttcggtctgccgtttattcctcctgagctcagagaaagcgggcaggaggtcgacacgtaccgggaagaaacggaccttgtggagcataaagcgataaaaggcgatctccacatgcactcagcctggagtgacggcgctttttccatcagagaaatggcagaagcgtgtatggcaaaaggctaccagtacatggcgatcaccgaccattcccaatatttaaaggtagccaacgggttaacggccgaacggctcagaaaacaggcggaagaaattgacgcgttaaacgctgaatttgaaaattttcatatttttaaaggcgtagaaatggacattctccccgacggttcgcttgattatgatgacagcgttctgtctgaaatggatcttgtcatcgcatctattcattcaagcttcagccagccggagcatgtcattatgaaacggcttgaacaggcgctgacgaataagcacgtggacattatcgcccacccgacgggacgcctgatcggcagacgggccggctatgaagtcgacatcgacatgctgattgagctcgcagccaaaacaaatacggcgcttgaactgaatgcaaaccccgcgcgcctcgatttacggactgagcatctgatcaaagcaaatgaaaaaggtgtgactttggtcattaataccgatgcccataatatcgagatgctcgatgatatgaaaacgggcgtgaccgctgcgcgcaaaggctggacagagacaaaacatgtgttaaacgcccggccgttacatgaggtcaaagcatttctgacgcgcaatgattaagtaaggaggaccataaaaccgtgcagcaaaaagtgttatcatcacttgaatttcataaagtaaaagaacagattaccgcacatgccgcctcatcgctcggcagggagaagcttctgcagctgaaacctttgacggatctcgccgacatccaaaaacagctggatgaagtcgaagaagcatccgcggtcatgcgcttgcgaggccatgctccgttcggcggcctgaccgacataagatccgctttacggcgggcggaaatcggcagtgtgctgacgccggcggaattcaccgaattgtccgggctgctgtatgccgttaaacaaatgaagcattttatcagccaaatgacagaagacggcgtcggcataccgctgatacaggcccatgcagaagagctgattacattaggcgatttggaaagggagattaactcctgcattgatgaccatggtgaagtgcttgatcatgcgtctcccgctttaaggggaatccgcacgcagctcaggacgcttgaatcaagagtcagagaccggcttgaatcgatgctgcgttcatcttccgcttctaaaatgctgtctgacaccatcgttacgattcggaatgaccgctttgtcatcccggtcaaacaggaatacagatcaagctacggcggaattgtccacgatacatcttcatccggtgctacactgtttattgaaccgcaggcgatcgtagatatgaacaactcgcttcagcaggcgaaagtaaaagaaaaacaggaaatcgaacggattctccggatgctgacggagcatacggctgaacacacacaagaaatcgctcaaaatgtggaagtgctgcagacactggatttcattttcgccaaggcgagatacgcaaaagcaatgaaggcgacaaaaccattcatgaacggagacggctttatccgtctgaaaaaagcgcgccatccgctgctgccccaagatcaagtcgtggccaacgatattgaactgggcggagattattcaacgatcgtcatcacgggaccgaatacgggcggtaaaaccgttacgttaaaaacactcgggctgctgacgataatggcgcaggcaggattgcacataccggctgacgagggctcggaagcagccgtatttgacaatgtgtttgccgatatcggcgatgaacagtcgatcgaacaaagtctgagtacgttctcatctcacatggtcaatatcgtcaatattttaaaagacgtgtctgaaaacagtcttgtgctgtttgacgaactcggtgccggaacagatccgcaggaaggggcggcgcttgccatgagcatccttgacgaagttcaccggacaaacgccagagtgcttgcgacaacccattatccggaactgaaagcatacggatataacagacaaggcgtcatgaatgccagcgttgaatttgacattgaaacgctttcgcctacctataaacttctgatcggagtgccgggccgaagcaacgcatttgaaatctcaagacgccttgggcttccggagcatatcatcggccaggcgaagtcagaaatgaccgccgaacataacgaagtcgatctgatgatcgcatcgcttgaaaaaagcaaaaaaagagcggatgaagaactttctgaaaccgaatcactcagaaaagaagcagaaaaactgcacaaagagcttcagcagcaaatcattgagctgaatgcccaaaaagataaaatgatggaagaagccgagcggaaagctgcggaaaaactggaagccgccgcaaatgaagccgaacagattatccgcgagctcaggtccatcaagcaagaacacagatcctttaaggaacacgagctgattgacgccaaaaaacgtctcggagacgcgatgccggcttttgaaaaatcaaagcagccggaaagaaaaacagagaaaaaacgcgagctgaagccgggcgacgaagtaaaggtgctcacattcggacaaaaaggggcgctgcttgaaaaaaccggcgagaaagaatggaacgtccaaatcggcatccttaaaatgaaggtgaaggaaaaagatcttgagtttctcaaatcggctcctgaaccgaaaaaagaaaaagcaatcaccgccgtaaaagggaaggattatcacgtatcccttgaacttgacctcaggggagagcgttacgaaaacgccctcagccgcgtcgaaaaatatttagatgacgcggtgctcgccggctatccgagagtgtccatcattcacggaaaaggcacgggcgccctccgaaaaggggtgcaggatcttctgaaaaaccaccgcagcgtgaaaagctcgcggttcggggaagcgggagaaggaggatcaggcgtaacgattgtcgaactaaaataaaaagggagaaaacgtcatgaatgctttttgggaaaatgagcttgttgaaatcgcggcttattacagtgttgccgtcttgtgtctcgtcatttttctgaccgtgtttgaattggtgacatcctataaaaactgggtggaaatccaaaaaggcaatcttgcggtggcaatggcgaccggagggaaaattctcggtatcgcaaatgtctttcagcacagcatcgcccagcataattcgcttttgcaaatgatcggctggggcgtatacggatttattatgcttttaatcagctattttatctttgaatttctgacgccccggtttaaaattgataaagaaattgaaaaagataacagagctgtcggctttatttcatttgtcatctcagtcggcctgtcatttgtggtggccgccgggatttaaggggacggggaaaaatggagaagcttgcgaaagtgctgctgtcggcagcggggatttttctgttcatcggacttatttatctggtcatgacatcttaatactgaaaaaaggctgccgaactcaaatcggcggccttttttattgagaataccagtttatgcaggccgtatcagagcaaatgacggcttcccaattcatggcgcggacgacagactgaatgtcttgttcttccatgagaaagagtgtcgtaaaagaatcatatatgctcataaaagcggcgcgccgttttttcatcggcaatgatcatgtcagcccgcagcagtccgcatacatccgaagccgccgtttgattgagtgaaaataggcctttctcttcgacaggctcataataagtgcagcgctttatgccttttgaacggaacacatccaaaagtcccggaatcaaaaatggcgaagtgacatcatcgctcggcaagtacagatcgggatgatggagccgatttaaccgctcggcggattcaggatgtgcatattcctcccgcaatgccgtgacagcagtcataagcgcaagcgccgtttctttttcagaacgcaggccgcaaatgctcatgacggtttgccaggaaacgggtctgcccatcgcgatgatctcctcatcactcggatacatatgttcataaggccgtttgcgcttttgctcttcccgaccatctggcatccggacaaagggatggagcaaaaaggcggccgacgtaatcggcttcggcagctggcgcaggataggaactcccccttcaaaatgcagcgtttccagaaaactcaacacctcctgaaactcgaaatttcccatgaaacgctttcccattccaatcacccttctgctataataatagcgtataggaaaacagaagggagaggtattatgcagtctgaaaagccatggctttctcaatatcccgaagagattccgcatgagcttgaatttaccgatcaaaccctgccatccaatctgacaaactccgcagctcaattcccgaaccataccgccatttattttctaggaaaaaaactcacattccaagacgttctcacagattcattaaagcttgccgcttttttacgcaaaacaggcctgaaaaaaggtgacagagccgccattatgctgcccaattgtccgcagtcggtcatcgctttttacggcgtattgtttgccggcggcattgtcgttcagaccaatcctctctacacggaacacgagcttgagtatcagctgaaagacagtgcgccgcgcgtgatcatcaccctcgatatgctgtttccgaaagtgataaaaatgaaaacgttatcactcgtcgaacgcattattacaacaagtataaaagactttttgccgtttccgaaaaatatgctttatacgctcacgcaaaagcaacaggtgcatattgattatgacggctgcgaacaaattcacaaattagcggatattttaaaaaacgaaaaagcagaggaagcagagccatttgatattgaccctgcgcatgacatcgccgtgcttcaatacacgggcggaacaaccggctatccgaaaggcgtcatgctcacacaccgaaacattcaggccaatacagaaatgtgcgccgcctggatgtacaaaatgaaaaagggagccgaaaaggtgctcggcatcgtgcctttttttcatgtgtacggattgaccgccgtgctcaatttttccattatgcagggatgtgaaatgatccttcttcctaaattcaatcctttggatacactgaaaacaatcgacaggttgaagccgacggttttccccggggcgccgacgatttacatcgggctgctgcatcacccggagctgaataagtatgatctgtcctccattgaaagctgtccgagcggttcagcggcactgccggttgaggtcaaacagaaatttgaaaaagtgaccggaggaaagcttgtggaaggctacggattatccgaagcatcaccggttacccattcaaacttcatctggggaaaaaataaacccggcagcatcggctgtccctggcccaataccgatgcgggaatctattcagaagaaaaaggcgggcttgcggagccgtatgaacacggcgagctgatcgtaaaaggccctcaggtcatgaaaggctattggaataagcaggaggagacggcgcgtgtcatcagagacggctggctgtttaccggagatatgggatatatggatgaggaaggatttttctacatcgccgacaggaaaaaagacatcatcattgccggcggatacaacatttacccccgcgaggtggaggaggcgctttatgagcatgaagccgttcaggaaatcgtggtagcgggcgtccctgattcctacagaggggaaacggtgaaagcatttatcgttttgaaaaaaggcgccgaggcagatgccgatgagcttgatgcgtttgcaagagagcggcttgcgccgtacaaagtcccgaagctgtacgaattcagaaaagagcttccgaaaacggccgtcggaaaaatattaagaaggcgtttagtcgaagaggaagatgcttcccatgaaaacaaggtgccttaaaagaaaaacttgacaaaatccggattcctttttatcatgaagttatgaatgaatagtcattcatttatcgaaggaaggaacgatgacattgaaccaaaaacggccaaagtatatgcagattattgatgcagcagtagaagtcatagcggaaaacggctatcaccaatcacaggtgtccaaaatcgccaagcaggccggcgttgcggacggcaccatctatttatatttcaaaaacaaagaggatatactcatttctctttttaaagaaaagatgggccagttcattgaacgcatggaagaagaagtgaaagaaaaaacgacggcaaaagaaaaactcgctctcgttattaagcagcatttcacactgctcggcaatgaccgccacctcgcgattgtgacccagcttgagctcagacagtcgaatatcaagctgcgtctgaaaatcaatgatattttaaaaggttatttaaacatgctggacaccattttgaccgaaggaatcgagtcgggcgaatggaaagataatctcgacgtccgcctcgcccggcagatgatattcgggacgatagatgaaacagtgacaacatgggtgatgaacgatcagaaatatgatcttccggatttgtcagacaaggtattggagctgttggtgtcagggattcatcaaaactaaagggggttgacggatgaacagcctttcgatggcggtagaacaatctgttgcggtgatcaccattaatcatcagccggcaaacgcgctgtccggcgcggttttagatgagttgtccggtctgttcgaccgctgtgaaacagatgacagtgtcagaagcatcatcattcgcggagaggggaaatttttctcggcgggcgctgatataaaggaatttacgtcgcttgaaaatcttgagcaatcttctgccatggcggataaaggccagcagctgatggaaagaattgaagggtttccgaagcccgttatcgcagcgattcacggcgctgcgctcggcggcggccttgagcttgccatggcctgccatatcagaatcgctacattagatgcaaagctcggcctgcccgagctgaatctcggcattattccgggctttgccgggacgcagcggcttccccggtacgtcggtacggcgaaagcgcttgaaatgatcggcacttcagaacctgtaaccggagaagaagcgctcagcctcggtcttgtcacgataggcgccgaacatgaggaagagctgctgcaaaaagcgaaaacgctcgcgggcaagtttgcggaaaaaagcccgcagtcgatggcttttctgcttgagctcctttattcaaacaaggtctattcttatgacggcggcttaaagcttgaagcaaagcgctttggggaagcatttgcatcagatgacgcaaaagaaggcattcaggcatttctcgaaaaaagaaagcctcaattcggtgggcgaagataaaggggataagaatatgaatctatttgtactgatgaaacggacgtttgacacagaagagaaaatcgtcattgaagcaggaaagattcaggaggacggggccgaatttatcattaatccgtatgatgaatacgccattgaagaagccattcagctgaaggaagagcacggcggaaccgtgaccgccgtaaccgtcggcggagaagatgcggagaaagaactgagaaccgcccttgcgatgggctgtgaccaggcggtgttaatcaatattgaagatgatctgagcgatcctgaccaatactccgtttcaactatcttatatcattatttcaaggaccgggaatatgatctgattctcggcggaaatgtcgcgattgacggcggttccggccaagtggctccaaggcttgccgaactgctgaacattccttgcgtcacaacgattacaaaactgacaatcagcggcgatgaagctgcggcagagaaagacaacgaaggggataccgaaatcattaaaacctcacttcctttagtcatcacggcacagcaaggcttaaacgagccgcgctatccgtcgcttccgggcattatgaaggcgaagaaaaaaccgctggaagaacttgagctcgatgatctcggcattgatgaagatgatgccgcaccgaagctcaaaacgatcgaacgttttctgccgccgcaaaaagaagcgggcagactgatcgaaggagaagcctctgagcaggcgaaggagcttgtatcactgctgagaaaagaagccaaagtcgtataaactgatattaaagaaactgggggatgtcagaatgggaaaaaaagtgatcgtactcggagaaattcgtgacggcgccttacggaacgtcacctttgaagccatagccgcaggcaaaaccatttccggcggaggagatgtcatcggcgtgctgatgggaaagggcgcggctgatgcagcatcagaactcattcagtacggcgccgacaaagtatttacggccgattcgccggggctttctcagtatacggcggacggatatgccgcaattctcggggatttgatcgaaaatgaaaagcctgatgcggtcattttcggccacacttctatgggaaaagatttgtcacctaagcttgcggcccggtttgaaacggggctgatttcagacagcacagatgtaagcgttaccggagataacatcgtttttacaagaccgatctattccggcaaagcctttgaacaggtgatttcaaccgatcctttcattctggcgacaattcgtccgaataatattcaggcattagaaaaagacgcgaaccggacgggtgatattgaagagcttgcggcgcctccggcagatttgcggacggtcattgaagaagtagtcaaaaaaacggcggacggcgtggatttatcagaagcgaaaattatcgtagcaggcggccgcggtgtaaaaagcaaagatggatttgaaccgttaaaagaacttgccgaggtgctcggagcagcggtgggcgcttcgcgcggcgcatgtgacgcggactactgcgactattctcttcaaatcggccagacgggaaaagtcgtcacgccggatttgtatatcgcctgcggaatttccggagcgattcagcatttggcgggcatgtcaaacagtaaggtcatcgttgccattaacaaagacccggaagcggaaatatttaaaatagcggactacggaattgtcggcgatttgttcgaagtggttccgcttctgactcaggaatttaaaaatgccaatattcattcataatcaaaaccctctggcttatttgtcagagggttttggtttgtgttaattagttcgtacaaattatagattaataaaacaacagattgacatgtacgaaccaatgtaataagcttttgtaaagcgcttacaaacttatccatacagcatacatcccagatagatcggctgtagtgctttcattcttattaaggggaaggaatgatcaagtttgtctcacaatacggcagtcattcaaactgatatcacacggggaaccattaataaaaacatatacggacatttcgcggaacacctgggaagaggcatatatgagggcatctgggtcggaaaagattccgatattccgaataccggaggggtcaggacggatgtcgccgccgccctcaagcagcttcagattcccgtcctcagatggccgggcggctgttttgctgatgaataccattgggcaaacggcgtagggaaacgcaaaacaatgctgaatacccattggggcgggacgattgattctaatgaattcggcacgcacgagtttatgatgctttgtgaactgctcggatgcgaaccgtacatcgccggtaacgtcggcagcggaacggttaaagaaatggctgattggattgaatacatgacgtttgaagcgggcacgccgatgtccgactggagaaaagaaaacgggcgggaaaaaccgtggaagctgaaatatttcggaataggaaatgagaactggggctgcggcggaaacatgcatcctgagtattatgctggcctttacagaaacttccaaacctatgtccgtaattacagcggtaatgaaatctataaaattgccggcggcgcgaatgtcgacgattaccgctggactgaaactttaatgaaaaaagccgcggatctcatagacggactgagcctgcattattacacaataccgggcgacttctggaaggggaaaggatcagcgacggagtttacggaagatgaatggttcatcacgatgaaaaaagcggcgcatatggatgaattgatcacaaggcacagcgccatcatggatcagtacgatcccgaaaaaagagtcgggctgatcattgatgaatggggcacgtggcttgatcctgagccgggcacaaatccgggctttctgtatcagcagaatacgatccgcgacgcccttgtcgccgccgcgcattttcacatttttcatcagcacgcagaccgcgtacagatggccaatatcgcgcaaaccgtcaacgtgcttcaggcaatgatcctgacagaagggaaagaaatgctgttgacgccgacgtatcatgtgttcgatatgtttaaggtgcaccaggacgcatctcttttggcggcagaaacaaatgcagccgggtacgaatggaatgacggccggctcccgcaagtcagcatttcagcgtccaaacagcagaacggagacatacatatcagcatttgcaatatcgatcatctgcacaaagctgacgtgaagattgaactgcggggcatgaaaaagacagggacgccttcgggaacgattctgcacgcggaaaaaatgaatgcccacaatacattcagcagtccggaaaacgtcaaaccgaagccgttttccgggtttgctcaaaagggaggaaaacttgaggcggagcttcctccgatggcgattgtattaatcacgctgcctgcaggtccatcttaagttttgaacgcccgccgcccggttataatacactgtataaataagattatttccggcgggttcgggggaaaataatataagcattaaattagcatgaacgaatgggagatgctatactaaaaatcatcatttgacaattggaggaataacaaatggctatcgtaaaagcaactgatcaatcgttctcagctgaaacaagtgaaggtgtcgtattggctgatttctgggctccttggtgcggaccttgtaaaatgatcgcgcccgttcttgaagagcttgatcaagaaatgggagacaaactgaaaatcgtcaaaatcgacgtggatgaaaaccaagaaactgccggtaaatacggcgtcatgagcatcccgacacttctcgtgctaaaagacggagaagtcgttgaaacatctgtcggcttcaaaccgaaagaagctcttgaagagcttgtaaacaaacatctgtaagccgaaagcttccgttacggcagggcgattcctttgaaaggggtcgcctttttttgatcttccaaaagctgagaatggagaaaaacaaatgttcgtgatacactgaatggacacgagaaatgaatgtaaggaagggtaacgtatggataaacaactgaaagaaaagctggccctccttcccgatcagccgggctgttatttaatgaaagaccgtcagaaaacagtcatctacgtggggaaagcgaaagtcttgaaaaacagggtgcggtcttatttcaccggttctcacgacgcgaaaacccaacggctggtgacggagattgaggactttgaatatatcgtgacttcctccaatcttgaagcgcttattttggaaatgaatctgattaaaaaatacgatccgaaatacaatgtcatgctgaaagatgataaaacctatccctttattaaaatcacccatgaacgtcatcctcggctgattgtcacccggaatgtcaaaaaagacaagggacgctatttcggcccgtatccgaatgtgcaggcggcgcgggaaacgaaaaaactgctggaccgcctttacccgctcaggaaatgctcaaagcttccggaccgcgtctgtctttattatcatctcggccaatgcctcgccccatgtgtaaaggatatatctgaggagacaaaccgcgagattgttgaagacatcacccgttttttaaagggagggcataacgaaatcaaaaaagagcttgaagcgaaaatggcagaagcggccgaaaagcttgaatttgaacgggctaaagaattccgcgaccagcttgctcacatcgaatcgacgatggagaagcagaaaatgaccatgaatgaccttctggaccgcgatgtgtttgcatatgcctacgataaaggctggatgtgcgttcaagtcttttttatacgccaaggaaaactgatcgaacgcgatgtcagcatgtttccgatgtatcaggaagcggatgaagagtttctgaccttcatcggccagttctattccaaaaacaatcactttctgcctaaggaaattctggtgcctgacagcgttgacagggacatgattggcgagctgttggaaaccgccgtgcatcagccgaaaaaaggtccgaaaaaagagctgcttttgcttgcgcacaaaaatgcgaaaatcgccctgcgggaaaaattctcgttaatcgagcgggatgaggaacggtcaatcggtgcagccgaacggctcggcgaagcactgaatatttacacgccgcatcggattgaagcgtttgacaactccaatattcaaggcacaaaccccgtatcggccatgattgtctttattgacggaaaaccgaataaaaaggaatatcgcaaatataaaattaaaaccgtaacagggccggacgattacggctcaatgagggaagtcgtcagaagaagatacacgagggtgctccgcgaaaatcttccgctgccggatttaatcatcattgacggcggaaaagggcagattaacgcggcgcgcgacgtgctcgagaatgagctcggccttgatgtcccggtagcgggactggcgaaagatgataaacaccggacatcgaaccttttgatcggcgacccgcttgaaccggtgtttctggagcggaacagccaagagttttacctgcttcagcgcattcaggacgaagttcaccgttttgcgatcagctttcacagacagatccggggaaaaagcgtctttcaatccgttctggatgatatccccggaatcggcgaaaaacgcaaaaaaatgctcttaaaacatttcggatctgtcaaaaagatgaaggaagcaagccttgacgatatcaaaaaagccggtgtgccggccgcggcggcccagttgctgtttgaaaaattaaaaaaatagtattgtgcttttctgaaaaatctgctagaatgtgaactaatttcataagatcgtgttatatggtgaagatagaggtgcgaacttcaatagtaagcctttggagaatgatggattctgcgaaaaaggctgaaaggggagcgtcgccgaagtgtgtcacatcccatcggtgtgatttgctggccttgcattaaataaatgtaaggctgtcaagaattcattttcttggagggctatctcgttgttcataatcaatcgtactgatatgaaaagcaatgagagctattcctctcattgctttttttattgtggacaaaacgctcttttctcctcacccgcacgaaccaaaatgtaaagggtggtctagtatgggtcttatcgtacaaaaattcggaggcacttccgtcggctctgccgaaaaaattcaaaatgccgcaaatcgcgccattgctgaaaagcaaaaaggccatgatgtcgtagtcgtcgtttcggcaatgggaaaatcaaccgacgcgctcgttaacctcgcggctgaaatcacatctgaaccaagcagacgcgagatggatatgcttttgtctacgggggagcaggtcacgatttcgcttttggccatggcgcttcaggaaaaaggatatgacgccgtctcttatacgggctggcaggcgggtgtccgcacggaagccgttcacggcaatgcgagaattacggatattgatatcacggcgattcgttcgcagcttgcagaaggcaaaattacagtcgttgccggttttcagggcgtaacggaagacggcggcatcacgacgctcggacggggcggttctgataccacggcggtcgctcttgcagcagcgctggaagcggataaatgcgacatttatacagatgttccgggcgtatttacgacagatccgcggtatgtccggtcagcgagaaaactggcggggatttcttatgatgaaatgctggaacttgcaaatctcggagcgggtgttcttcacccgcgggcggttgagttcgcgaaaaactaccaagtgcctttagaagtgcggtcaagcacggaacatgaagccggaacattaattgaggaggaatcatcaatggagcagaatttaatcgtcagaggaattgcatttgaagaccagatcacaagggtgtccgtcacgggccttgcaagcggactgacaacactttcaacaatcttcaccgcgctggcaaaacgaaacatcaacgttgacatcattattcagacacagtcggatgatggggaagcggatatttctttctcagtgaaaacggaagatgccgcccaaacggtcgccgtgcttgaagaatataaaaacgcgcttaactatgaaaaaattgaaaccgaaagaaaactggcgaaagtctccattgtcgggtcgggcatggtttcaaatcccggcgtcgccgcggacatgtttgccgtactggcggaaaaaaatgtacaagtcaaaatggtaagcacatccgaaataaaagtatcagcggttgtcagcgaaaatgatatggtgaaagcggtcgaagcgcttcatgatgcgtttgagctgtctaaacagccgtctgccgtataaacgggcaggcaaaaaggcgggacttttgagtcaccgcctttttcaattatacagggtccttcatatcccattttacagtcaggacgactttatccgctctcttttttacctgttcataagattctgcaatctgatcgttcatcaattgaatctgttcggctataaaaccggcttcaagctggaaacaaggctctttctgatgtttgagcctgctggatacgagcggtccttccagttcaaattccagttcttgttttttcgatcctgcgtttgtcaaagttccccagccggctttttcaaaaaaggcggggatttcttcccacgattgaagaggaaatttgcgggcgaggcgttttcccgcccaatacatcatcgatgaatgatccggaccgaggatatccggaagcacgatttcccggattaattcgtagccgtatgcgctgacgtcgagttcagttaaaggttctaaagctgcttcataattattcttcatattatgtattcccctctctccttcgtttattatagcttaaacaggggggaggattacaggatgatcctataaaacacgcgaaaaaatgtgagaaagatatcgcaggaaaataaaattttccctccagataatcaattccgaaaattataatttatgtacacgttttcttgacgcccttttgagggaggagtaaaatgaaattgtcaataaattttaataaagtgcttacaattgaaacgaagtgggggcagagattttagtacatttcgcacttaaatcaaacagggggtaaagtaatgtctgggaacagagagttttattttcgaagattgcattccttgctcggtgttattccggtcggcatctttttgatccagcatttagtcgtcaaccaatttgccgcaaggggagcggatgcgtttaacaaggcggccggctttatggacagtctgccgttcaggtatgcgttagaaatttttattattttcttacctttaatttatcatgcggtttacggtgtgtacatagcatttactgcgaaaaacaacgctggccactacagttatttcagaaactggatgtttgtgcttcagcgtgtcactggtattctcacccttattttcgtcagctggcatgtgtggcagacgcggattgccgcgcagatgggcgctgaagtcaacttcgatatgatggcgaatattctgagctcgccgtttatgctcggtttttacattgtaggcgttttatcggtcattttccacttttcaaacggcttatggtcttttgcggtcacatgggggatcacggttacgccgcgttctcaaagaatttcgacttacgtgacgctgattatatttttagcgctttcatacgtaggtttaaaagcgatttttgcgtttgtgtaagagaactagattactagagggagaggggctatcatgagtcaatcaagcattatcgtagtcggcgggggtctagccggcctcatggcgacaattaaagcagcggaatcaggcacggccgttaaattgttttccatcgttccggtcaaacgctctcactcggtctgcgcgcagggcgggataaacggagctgtcaacacaaaaggggaaggagactctccgtttgagcattttgatgacacggtatacggaggcgactttttggcaaaccagcctcctgtaaaagcgatgtgtgaagcggcgccgtccattatccacttattggaccgcatgggggttatgtttaacagaacgccggaagggctcttggacttccgccgtttcgggggtacacagcatcacagaaccgcttacgcgggagcgacgacgggtcagcagcttctttacgcactggacgagcaggtgcgcagatatgaagtggcgggtctcgtcacaaaatacgaaggctgggaattcctcggcgccgttcttgacgatgagcgcacgtgccgcggtatcgtagcccaaaatctgaccaatatgcaaatcgagtcattccgttctgacgccgttattatggcgacgggaggacccggaatcgtattcggaaaatcaacaaacagcatgatcaatacgggatctgccgcatcaatcgtctatcagcagggcgcttattatgcaaacggcgaatttatccaaattcacccgacagcaatcccgggggacgataaactgcgtctgatgagtgaatcggcgcgcggcgagggcggtagagtctggacgtacaaagacggaaaaccttggtacttcctcgaggaaaaatatccggcttacggaaacctcgtgccgcgggatattgcgacacgtgaaatctttgacgtgtgcgtgaatcagaaactcggcatcaacggagaaaacatggtgtatctcgatctgtcgcacaaagatccgaaagagcttgacgttaagcttggcggcattatcgaaatctatgaaaaattcatgggcgatgacccgcgcaagcttccgatgaaaattttccctgccgttcactattcgatgggcggactgtgggttgattatgatcagatgacaagcatccgcggactgttcgcagcgggtgaatgtgattattcaatgcacggaggaaaccgtttaggggcgaactctctgctttccgccatctacggaggaatggtggccggaccgaatgcggtgaaatatgtttccggacttgaaacatcagcggaagacctgtcttcttcattatttgattcctatgtgaaaaaagaagaagaaaaatgggccgatatcatgaagatggacggcgatgaaaatgcctacgtgcttcaccgtgagctcggagaatggatgacggccaacgtcacggtggtccgccacaacgacaagcttttgaaaacggatgacaaaatccaagagctgatggaacgctttaagaaaatcaatatcaacgatacgacaaaatggagcaaccaaggggcgatgttcacccgccagttctccaatatgcttcagcttgccagagtcatcacgctcggcgcatataaccgaaatgaaagccggggagcgcactataaaccggatttccctgaaagaaatgacgatgagtggctcaaaacgacgatggctaaacatgccggtccgtttgaagctccggaatttgaatatcaggatgtcgatgtatcactgattgcgccccgtaaacgcgactactcgaagaagaaggtggcgaaataatcatgagtgagaaaaagatacggtttatcattacacgccaggatacgcccgaaagcgcgccatacgatgaagaattcgaaatcaattaccgcccgaatctgaacgtgatttccgccctgatggaaatccgcagaaatcccgtgaatgcaaaaggagagaaaaccactccggtcgcatgggacatgaactgtcttgaagaagtatgcggcgcctgctccatggtcatcaacggaagaccgcgccagtcgtgtacggcgctgattgataagctggaacagccgatccgtctgaagccgatgaaaacattcccggttgtccgtgaccttcaggttgaccgcagcagaatgtttgattcactgaaaaaagtgaaagcatgggtgccgattgacggaacttacgatttggggccggggccgagaatgccggaaaaacgccgccagtgggcatatgaattgtctaaatgcatgacatgcggcgtctgccttgaagcctgcccgaacgtcaacagcaagtcgaaattcatggggcctgccccgatgtcacaagtgcgtctgtttaatgcccatccgacgggcgcgatgaacaaagcagaacgtttagaagctttaatgacagacggcggcctcggagattgcgggaattcacaaaactgtgttcaatcctgcccgaaaggcattccgcttacgacttcaatcgctgctttgaacagagataccaatttacaagcattccgtaatttcttcggaagcgacagagtataagaaagagaaaaagagcctcttccgcacgggagaggtttttttataaggagctgaaggtgatgaaacaaccgcaatatattgatatcccgtttgaagaatggagacagtcgttttctttctttactgaagtatcggttcgtttttcagaaacggatatgttcggccatatgaataatgtaacccctttcatctattttgaagaagcacggatcgcttattttaaacagcggggcatgacggcgcaaaactcggaaacgatgacggtcgtcgcaagccagcagtgcgactatatgcgtcaggtgatgccgtatgaaaatctgcggatttatgtgaaagcaagcgctgccggaaatgcgtccgtcacccttcattaccttggagaaaatgagtcgggcctgccgtgctttacaggttccgtcgttatggttcaagtgtcgaaaaaaagcggcaaagcggtcagctggacggagcgggagaaaggcattctgctcgcctgaacggataactatttctctaagagacgtcacctccgaagcgccctttacatatgatatcttgactatataaacccattcgtttcagattcgctctcaccttagcaaggagggttacaatacttgaaggagaaagattttcaatcaaagccgctgctgaccaaaagagaaagagaagtattcgaattgctcgttcaagacaagacaacaaaggaaattgcaagcgagctatttatcagtgaaaaaactgtacggaatcacatttcaaatgccatgcagaagttaggtgtgaaagggcgttcgcaagctgttgtcgagcttcttagaatgggtgagctagagctctgattcttgccggttttccttctttacgagaaggagccggttatttgcgttggcgcccgggctgatgggcatgcggtgaaaatcccggtttttcctttttctccgtcagtcttgcattttcttaaaaaaagaaggaaaatagacacggagcgcatagcccagaaagatccttgagtgagggatggacaaatgacatcaaaatctgtagagcatgttgcggatatcgaaaaatcactccgccatatcgctgcgatcattaaacaaaaaggaagagaaatccttaaccaatatgcaattacaccgccgcaattcgtggggcttcaatggctttatgaattgggggatatgacaataggcgaattatcaggcaaaatgtatttggcttgcagcacgacgacggatctgatagaccgcatggaaaaaaataagcttgtcgagcgggtcaaagacccggctgacagacgggtcgtcagaattcatcttctcgctgaaggagagcgcattatccaagaagtgattttgaaaagacaggcttatttgcgggatatgtttgcgacattttccgaagaagaaacagccgctttcgaaaaatcattattgaaactgcagcatgaaatgaaaagaaaatgaggcgattttgttggaacagccgataggagtcattgattccggggttggcgggttaaccgttgctaaggaaatcatgagacagctaccgaaggaaaatatcatctatgtgggagatacaaaacgctgcccgtacggcccgcgtcctgaagaagaagttcttcaatacacgtgggaaatgaccgattacctgctggaaaaccaccatatcaaaatgctcgtgatcgcctgtaatacggccacggccattgccttggaggatattcagcgcaaaacggatattccggttgtcggcgtcattcagccgggtgcgagaacggcgataaaggtcacgaaaaaccagcatatcggcgtcatcggcacggtcaataccattaaaagcagagcgtatgagcaggcgctgctcgggttaaacgcagaacttcaagttgagaacacggcttgtccgctgctcgtgccgtttgtggaaagcggacggtttcttcaggaatcagcggaggaagcggttgaagcatcgcttgaacctttaaaaggtacatcaattgacaccttgattttaggatgtacgcattatccgatcttaaaagacccgattcagaattatatgggagagcatgtgaaaatcatttcctccggagacgagacggcgagagaagtgagcaccatcttgtcttataaaggtttgttaaaccaatcgaaacatgcaccggagcatcaatttcttacaacgggagagcggaacggcttcgcaaaaattgccgaagactggttcggccacgaaatcggccatgtcgagtgcatctcccttcaagagccggtcagaaaataaatcaaaaaaaccccgctgtttacagcgggtttttttgcgcttcccggtctatttcccggacagggctcgtatacatcatagtacaaacagccttaggagggaaaagtatgctgaaaaaaggacctgcagtcattgctgcaacatgtcttacttcggcttttgtgttatctggatgcggtttgtttcaatccgataaaacagccggggaaattgacccgcctcaagacatttcatatgtaaaggatgaagcgggaattcaggcaaaaccaaagcagtcagagaaaaacggcacttctaaagccgaccagccggccaatacagtcatgcgagaactgtatctgattgataaaaacggctatgtcgcagcacagacactgcctcttccgaacagtgagggaaccgcaaagcaggcccttgagtacttggttcagggagggcctgtatcagaaatcctgccgaacggcttcagagcggtgctccctgcggatacgacggtaaatgtcgatattaaaaaagacggcactgcagtcgctgatttttcgaaggaatttaaaaactataaaaaagaagacgaacaaaaaatcctgcaatcgattacgtggacgcttacccaattcagctcaatagataaagtcaaaatcagaatcaacgggcacgaactgaaagaaatgcctgtgggcggcacgccgattacgggcgacttaagcagaaaagacgggattaatattgaaacggccggagtgaatgatctgacagacacccatccgctgactgtatattatctggcggaaacagagacaagcgaatactacgtgcctgttacaaagcggattgacaattcggaaacaaatgacatcaccgctgccgttgaacagctcaccgacggaccgggcaaagcaagcgggcttttgacggactttaataacgatgttaagcttctcagcaagccgaaagtgaaagacggccaggttacactggactttaacagctctatttacggaagcgccgacgaaaaaacaaaaatggtgtcatcgggcgtactggacagcatcgttctcacgttaaccgaacagccgtcgattaaaagtgtttctataaaagtaaacggaaaatcagaactggtgaatgaaaaaggagaatccctttcaaaacctgtttcgaggccggcacaagtgaatacgggtagtttttaatttgcgatttttgatatactagtaaaaaagaggttagcgttccggctgcctctttctttattcacaatccggaacaaaaggtttatgtacatataatcggaggtaaaatatgagacacgacggaagacagcacgatgagctgcgccctatcacatttgatttggattttatcactcacccggaaggctctgttttaattacagcgggaaatacaaaggtcatctgtaatgcatctgtggaagaccgggtgccgccatttttacgcggcggaggaaaaggctggatcacagcggaatacagcatgcttccccgcgcgacgaatcaaagaacgataagagaatcttcaaaaggaaaggtctccggcagaacgatggaaattcagcggctgatcgggcgcgcgctccgggccgtcgttgatttggagaagctcggcgaacggacgatctggatcgactgtgacgtcattcaagctgacggcggaacaagaacggcttccattaccggcgcattcttggcaatggccattgcgaccggcaaactcgtaaaaagcggcgttatcaaaacctctcccgtgacagattatctcgcggccatttctgttgggatggataaagaagaaggccttcttttggatctgaattatgaagaggattcggcggctgaagtcgacatgaatatcatcatgacgggaagcggacgttttgtagagcttcaagggacgggcgaagaagccacattctcccgtgaagatttaaacggactgttaagccttgccgaaaaaggaatccagacgcttattcaaaagcaaaaagaagtgctgggagaaacattgcctgaactgaaataagaaagagaggcctgatcagcgtgaaagaagtcattattgcgacacacaatcagggaaaagtgaaagaattcaaggaaatactcgaaccgaaaggctacagcgtctcttctttggcggaaatcggatttacggaagaaattgaggaaaccggacatacctttgaagaaaacgccatcttaaaagcggaagccgtggcaaaagccgtcaacaaaatggtcattgcagacgactccggtttatcagtggacaaccttggaggcagaccgggcgtttattcagcccgttatgccggagaagcaaaagatgataaggcgaatatggacaaggtgctgtcagaattaaaaggcatcgaaaaagagcagcgcacggcccgtttccgctgcgcccttgccgtcagcatgccggggcaggaaacaaaaacggtcgaaggtcatgttgaagggtatattgcagaaggacccgaaggagataacgggttcggctatgatcccatttttattgtaaaagataaagataaaaccatggcccagctgacaagcgctgagaaaaacaaaatcagccacagggctgaggcgctcaagaaactgtcaaagctgcttgattcataagggggagcgtatgcaatgaaagtgctgataataagtgacagtcacggccttgaagacgagctggagacgattgcaaagcggcacgaagacgaagcggatctgatgattcattgcggtgattcagagcttgacgccgcacatccggcactcacgccgtatcacaaggtgaaaggcaattgcgactttggcggcgggtttcaggatgaactccttctggatgccggttcaaagaaaattctggccgttcacgggcatcttcacggcattaaacagtcacttttaactgttttttaccgggcggaagagcttggggcggatatcgtctgcttcggccattcacatattgcggggagtgaagtgcttcggggcaagcttttgattaatccgggcagcatccgtcttccgagagtccgcaatgtgaaaagctatgccattcttactcttacagaaagagaaggcgccgtgacattttacgacgaaacgggtcgggaattgaaggacttggggaatacaatcagtttttaacaagtgatgggggagatttcattcttccccatcaaaagttttttaaaaaatattgacttatgatttgaacctgtatataataaatcttgtcgctgatacataaagcaaaagctgtcccagtagctcagctggatagagcaacggccttctaagccgtcggtcgggagttcgaatctctcctgggacgtacaaaaaaagagctggtgacatcagagtgaaaactgatgccgctggccttttttatcggatgactatattgtcaattcactgatatcatggtaaaataatcagcagatatttgtttttcatgtcccagtagctcagccggatagagcaacggccttctaagccgtcggtcgggagttcgaatctctcctgggacgtataaaaaacctcaagccctgacaatgggtttgaggtttttttgtattttatttttagttttacgaaacaaaagttccgtatttgatgaaaattgtaaagtaattttaatgtaaatgaaacttaatgtaatatttaccgtaataaatatatgtataaagatacttaaggcgcccttgagtgataaattatctgatttctatcatacgttttgttgatgattgatagaaagacagcaggaggaattagcttttgaagtacgcatttgcatataaaaatcacaatatagaaacgatcttttgcggaaaagacgagctgtttgaggaactgaaacaatttttaatcactcaatgcggtttaatcattgttgaggtttcaagggctgattactatacggagcaggaaatgaatcagtggaatgaacgttatactctgtgaataagaaaagaaaccggccgtgtgagaccggtttttgtatcatctgaatccgctcggagcgctgaagcccccggcatggccgctgaaaccgccaccgagcgcgccgggatgtgccccggcgccgaggcttccgccgacgtcactgaaggtttggccgtagtacccggatgtataagggtacggaacgaattgctgtccggcgaatgacagtgtgctttgcggggtctgctgtccgtatccggatggcggaaatccctgctgaaaagaagggccgccttgatatggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtataaagagcctgttcaatcgaacggaatatctgacaagcatgccggaaggacagagaaaaatcgcgtaataaaatgtgacatattcgtatatgaacggaaaaatttcatgtaatcttgagagattaataaaaaaaatataaaaacttttaacatttgccgatccttttatatcagtaatgaaagcgtatacaaaatagattgattaatctaaattgtctaataattataaaaatgctgttgacactgtctgcaaacgggcgtaatatgagttcaaacaaaaataaataaatgattcacactaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatgtaaagagtaggactcggccgagtgaacgcaatgtttactcgttatcaaaacggataatcattatccatgagacggtctgcatatgaccgtaaacaagggtggtaccgcggagagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgctgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaatcttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgttcggatttcatcggaagaagaggcggaagaagagcttaaaaaggcgctttcatcaaaagaaccggccgttattgacgtccgggtcgccaaaagcgagaaagtattcccgatgatcgcgccgggtaaaggacttcatgaaatggtgggggtgaaaccttgaaacgcattatcacattaacggtggtcaaccgctcgggggtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcatcgtcgttcaggttaccggcgaatctaataaaatcgaagcgctcatagagcttctcaaaccttacggaattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcatgcacacgcgctgaacttaaaagaaagcggaattgatgtcattgtcggcgtcagacaaggcaaatcatttacacaggcccaagaagacggtcataaagtcttttcggtaagagaagcggctgcccaggctgatatcattatggttcttcttccggatgagcagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggacctggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggggttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagctgatcgtagacttgatgtatgaagaaggattggcgggcatgagatactctatttccgatacggctcaatggggagactttgtatcaggaccgcgcgtagtcgatgcgaaggtaaaagaatcgatgaaacaagtattaacggatattcaaaacggtacattcgcaaaagaatggatcgtggaaaaccaagtgaaccgtcctcgtttcaatgcgatcaatgcaagcgaaaacgagcatcagattgaaaaggtcggcagacagcttcgtgaaatgatgccgtttgtcaaacaaggcaaaaagaaggaagcggtggtctccgttgcgcaaaattaatgttttcgacacgacccttcgtgacggtgaacaatctcccggggtcaacctcaattcccgggagaaactggcgatagccaagcagcttgaaagactcggggtggacattattgaagcgggatttcccgcttcatcccgaggtgattttttagccgtgcaggaaatcgcaagaacgattaaaaattgttcggtaacagggcttgctcgatctgtcaaaggtgacattgacgcagcctgggaagcgctgaaagacggggtcagcccgcgcattcacatctttatcgccacctctgacattcatctgaagcataagctgaaaatgacgcgggaagaggttaaggaaaaagcggttgaaatggtgaagtatgcaaaagaacgctttccgatcgttcaatggtcggcagaagacgcatgccgcaccgaacttccgtttctggctgaaatcgtagaaaaagtgattgatgccggcgcgagcgtcatcaacctgccggacactgtaggttacctgacgcctgctgaatacggaaacatctttaaatatatgaaggaacacgttccgaatatcagccgggtaaagctctctgcccattgccacgatgatctcggaatggcggttgccaactcactttcggcaattgagaacggcgctgatcaaattgaatgcgccattaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggcatggccgttccccgcaacaaagcaatcgtcggagataacgctttcgcacatgaatccggcattcaccaagacggtttcctgaaagaaaaatcaacatatgaaatcatttcaccggaacttgtcggcgtgactgctgatgcgctcgtactcggaaagcattccggacgccatgcgttcaaagaccgcctgaatgcgcttggattccagtttgatagtgaggaaatcaataaattttttacgatgtttaaagaactgaccgaaaagaaaaaagaaatcaccgatgatgacttgatttctcttattttagaagaaaaagtgacggacaaaaaaatcggctatgaatttctgtctctgcaagtgcattacggaacgtctcaggtgccgactgcaacagtctctttgaaaaatcaggaaaacgaacagctgattcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttatgtcagagtgaccgtgaacggaaaagaaacatcagggcggggaatcgcgcaggatgttctggaagcttctgctaaagcttatctgaacgccgtgaatcggcagttggtgctggattgcaatttagacggattaaagagacggactgcggtcggctcgtaatagaaaggagaacgtttgatttgaaaaaacgcattgctttgcttccaggtgacggaatcggaccggaagtggcggaatcagcggcagatgtattgaaaagcgttgctgaacaattcggacatgaatttgaatttgaaaacgggctgatcgggggagcagcgattgacgcccatcaaaacccccttcctgaggagacggtggctctttgtgaaagatccgacgccatcctgctcggggcagtcggcgggccgaaatgggaccaaaaccctccggagctcagaccggaaaaaggcctgctcggcatcagaaaaaagctcggcctgtttgccaatctgcgtcctgtgaccgtatttgaaagcctgtctgaggcgtctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgccggcagaaaaggaaaagtgacgtccgttgataaggcgaatgtgctttcttcaagcagactgtggcgtgaaacggcagatgaaatcgcaaaagaatttcctgatgtgacgcttgaacatatgcttgtcgataatgccgcgatgcagctcatctacgctccgagccagtttgacgtcatcgtaactgaaaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagcggcgatgcttttgagaacatctttcggacttgaaaacgaagcgcaggcggtggaaaaggcggtcgcaaaggtgcttgcagacggcagccgtacacgtgatatcgcccgggacggccaatatgccggaacgcatgacattactgaaaaagtaaaagccgcattagccggctcgaatacaaaatctatagtatgacgctttaaagaaagcggtcttagttcaataggtagagggaggaaacaaagatgatgcctcgaacaatcatcgaaaagatttgggatcggcatgttgtaaaaagcggtgaaggaaaacccgaccttctctatattgatctgcacctcattcatgaggtgacgtctcctcaggcgtttgaagggttaaggcagaagggaagaaaggtcagacggccgcagaacacgttcgcgacgatggaccacaatattccgaccgtcaaccgttttgacattaaagatgaagtcgcaaagcgccaagtaaccgcgcttgaacggaattgcgaggagttcggcgtccgtcttgcggatcttcacagcgcagaccagggaatcgttcatgtggtcgggcctgagcttggtctgacacttccgggaaaaacgatcgtttgcggagacagccatacatcgactcacggcgcgttcggagcgcttgccttcggtatcggcacaagtgaggtggaacatgttctttccacacagacattatggcagcagcggccgaaaacgcttgaaatccgcgttgacggaacgctccaaaaaggagtgacagcgaaggatgtcatcttgtcggtcatcggaaaatacggggtgaaattcggtaccggatatgtcattgaatacaccggggaagtattcagaaacatgtctatggacgaacgcatgactgtctgcaatatgtcaatagaagcgggagcccgtgcgggactgatcgctcctgatgacacgacgattgaatactgtaaaaaccgtaaatacgcgccaaaaagcgaggaatttgaaaaagccgccgcagaatggaaagcgttaaaaaccgatccgggcgccgtatacgatcattccatcgtgttagacggcagcgagatttctccaatggtaacatggggtgtcaatcccggcatggttcttccggtcgatgcccaaatacctgcgccggaaacgattgattctgaagacggtaaaaaagaagccatccgcgcttacgaatacatggggatcgcgccgaatcaaaaaattgaagatattaaagtcgagcatgtgtttatcggctcctgtacaaattcacggatgaccgatcttcgccaggctgcggatatgatcaaaggccgaaaagtcgccgacagcgtcagagccattgtggtgccgggttctcaaagcgtgaaacagcaggccgaggaagaagggctgcaccgcgtgtttctcgaggccggctttgaatggagggaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcggccattcacgggcatttcgtcgatgtaagaaagttttatcaagaaaaaacagttgtgtaaggagtgcgcgaaaagatggaacctttaaaaacgcatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaaccgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcagaactgttttaaaaacggtatgcttcccatccgtatgccgtatgatcagtggaaaaaactcgccggtcaatatgaaaatcagtctctaaatatgacggttgatttggaaaaccagctcattcacgacagtgaaggaaaagagatttcatttgaagtcgatccgcactggaaggaaatgctgattaacggttatgatgaaatttcattaacgcttctgctggaggacgacattcagcagtttgaatcgaaaagaagttcatggcttcaagcctgaaaaaagccgcccggcatctgtccggcggctttttttaccgtgtgcatcatcctttcttgtgtttcatgacgcgtgttgatacacttgaacaaaataagcgcctgaaaggaaataaagtatgacgcatgacaagaaaaaagctgatatcattcctttcccccgtctgaaagaacgcttggttgataaagggatggccgccatgaaggataaacagtatgaggaggccctcgaactgttttcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtattgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggaggaggcgtgggaggaggaatacgaggacattcttgatacggaaaaagtgctgaacagccccgctgaacaaatgaatctgattcattctcttaaagaccgcaatattgcaaaatacacgggtctcttaaaaacgattcttcaagatccgggcgcgcatcctcttattaagacaatgattttgacgctgatggccgagcacgactacagtaaaccggtccatattacaaaattcggcgattcaatgaccgcgataccgagtgaaacggtccagcctgatgcggctccgattttgcatcgcgttctccgggtgcttgatgaaacgctgggcaatgaaaaccctacattatatgctgccgtcgaggagctgtggagaagacatctgtacgtcctgcacccttttatgccgaagtttttgaacgcggatttatgggcggcggcgcttcataaggtcggttacgagatgcacggcattgacattgagccggaggaacttcatatgatgtacgagtttgacagccgcgaactcgaagaagcctgcacgatgattaaggatattgaagaaatttcttatttgtaaatcacaccatatagttgaaagcggtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgcggatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttaattttcactgcaaaagtgactgtaaaaccggaagtgaaacttggcgattacaaaggcttaggaatcgaaaaagatgacactgccgttactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactactcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaaccgagaaaacaaaaaaacgccttgaagaagcaaaagaaaacgaagctgacgctaaattgcgtgaagagcttgttctgaaagcatctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcagaaaaccttgaagtaacggacgaagaagttgaagcagagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacggaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaattccaacagtaaagtggatgatgttgagctttctaaaagtaatatttctttaatcggaccgactggaagcgggaaaacacttcttgcccagacgcttgcgcgtattctgaacgttccgtttgcgatcgcggacgctacatctctgactgaagccggatatgtcggtgaggacgtagaaaacatcctcctcaagctgattcaggcagcagactatgatgtggaaaaagcagaaaaaggcattatctatatcgatgaaatcgataaagtagcgcgaaaatctgaaaacccgtccattacacgcgatgtatcaggcgaaggcgttcagcaggcgctgctgaaaattcttgaaggaacggttgcaagcgtgccgcctcaaggaggacgcaaacatcctcatcaggaattcatccagatcgatacgacgaacattctgttcatttgcggcggtgcatttgatggcatcgaacaaatcatcaaacgccgtctcggacaaaaagtcatcggcttcggctctgataataaagcggcagacctggaaaaagaagaactgctttctaaagttcttccggaagacctgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaaggcgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcgccgcgtcttgtattaaaagacggtactgttgtcggccaagataaaacatcagcataacacgacaaaacctcctgacccgaattaatcaggaggtttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggactatatttttggaatctgctcaaaaaccagcgaacacaaaaagtgacgatagataaagaatcaaaaaaggaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggttggtattggaagaagcgaaaaagcataaacagtcaccgtttcaaaagcaggctgtttttgttgaacttgatgcgacgaccgcgcgatttgatgaacgggggattgccgatccgcttatcggttcagtgcatgatccgatttatcagggagcgggtgcgatgggccaagcaggcattccgcagccgaaacagggggctgtgacccatgctcacggcggggtattgtttattgatgaaatcggcgagcttcacccgattcagatgaataaaatgctgaaggtgcttgaagaccgaaaagtatttttagacagtgcgtattacagtgaagaaaatacgcaaataccgaatcacatccatgatatttttcaaaatgggcttccggcggatttccgtttgatcggagcgacaacgagaatgccgactgaaattcctccggccatccgttcgcgctgtcttgaagtatttttccgcgagctggaaaaggatgaacttaaaatcgttgcgaaaaaagcagccgacaaaattcagaaagagatttctgacgaagctctcagcgtgctgaccgcatatacgagaaacggacgtgaagccgtcaatatgatccagatcgctgccggcatggcggtgactgaggacagaaaagaaatcacgactgaagatatagaatgggttgttcattccagtcagctcacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcgaagggatctgtggaaaatgtgctgacggttctccgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccttatgaaaatcagcagtccattctgaaacgaatagacggaatcaccattaaagcggtaaaaacgttccaggaagtgcttgacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattaaagcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggatgattcaaaagacgtggaagacgaagcgcttatgcggacgctgctggaccattttgaccagtacataaaaatttctaaaaaaatttccgcagaaacgtatgcggctgtgactgatattgaagagcccggcagaatggcggatatcgtcgcttctcatctcccgctgaaattaaaggacaagcaggacattctagaaacggcggatattaaagaacgtctgaataaggtcattcgttccattcataatgaaaaagaagtgctggagattgagaaaaaaatcggtcagcgcgtcaaacgttcgatggaacgcactcaaaaggaatattatttgcgcgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatattgactggctcatcgcccttccgtggtcggatgaaacagaagataaacttgatattaaaaaagccggggaaatcttagataaagagcatcacggcttagagaaagtgaaagagcggattttggagtatttggccgtgaaacagctgacgaaaacgctgaaagggccgattctttgtctggccggacctccgggagtcggtaaaacatctcttgcaaaatcaatcagtaagagcatggggcgcacttttgtgagaatttcactgggcggagtgcgcgatgagtctgaaatccgcgggcaccggcgcacatacgtcggggcgatgccgggccgtattatacaggggatgaaaaaagccggcaaacaaaatccggtctttctcctcgacgagatcgacaaaatgtcgtctgatttcagaggcgatccgtcttcggcgatgcttgaggtgctggatccggaacaaaacagcacattcagcgaccactatattgaagagacgttcgatttatcgaaagtactgtttatcgcgactgcgaataaccttgcttccatccctggccctctcagagacagaatggagattatcagcctgtcaggctacactgaaaacgaaaagctggagatcgtgaaagatcacctgctgccgaaacaaatcaaagagcacgggctcacaaagagcaacctgcagattcgggatcaggcgattacggacatcatccgctactacacgagggaagccggcgtgagaacgcttgaacgccagattgccgccatttgccgaaaggctgcgaaagccattgtgtctgaggagagaaaacgcattaccgttacagagaaaaatctggccgactatctcggaaaacggatattcagatacggacaggcggaaaccgaagatcaaatcggggttgtcacggggctcgcgtatacgacggtcggcggagatacgctgtcaatcgaagtgtcattgtcaccgggaaaaggaaagctggttctgacagggaagcttggagatgtcatgcgggaatcagcgcaggccgctttcagttatgtccgttcgaaagcggaacagttcggaatcgacccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaatcacgctgcgggggcgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggcagatcaaatgtaggaaagtcatcttttatcaattcattaatcaatcggaaaaacttggccagaacgtcatcaaaaccggggaaaacacagactttaaacttttacatcatcaatgatgaattgcattttgtcgacgttcccgggtacggatttgcgaaagtttccaaaagcgagcgggaagcatgggggagaatgattgaaacctatatgacgacccgcgaagagctgaaagcctgcgtgcagattgtcgacctcagacacgcgccgtctgctgaagacgtgaacatgtatgaattcctgaagtattacggcattcccgtcatcgtcattgcgacaaaagcggataagattccaaaaggaaaatgggacaagcacttaaaggttgtcaaacagacgcttgatatggatcctgaagatgagctgattttattttcctctgaaacgaaaaaaggcaaagatgaagcatggggagccattaaaaaaatgatcagccggtaatgaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcagccgcttcgtatacatattcttttctggcagccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcacagcccccaagagcataaggagcaccggccattccccctgattcgcaaacaggtgaacctgtccgctctgaagccatgcaaataatgaagcggcaagcagaagtcccggtaataaaattgatgtttttttcatcctgtcacctacccgcagtaaaggatttttagtatgatgattacagtgggaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgctccgcttaaaagaagaaaaaagcgttctagaaaacattatcgtgtcaacctgcaaccgcaccgaaatatatgcggtggtcgaccagcttcataccggccgttattatataaagacatttttatccgaatggttctcgctgccgaaagaagagctgtctccgtttctgaaattttatgagagcgacgcggcgatcgagcatttattccgtgtggcgtgcggtttagattccatggtcatcggagagacgcaaatactcggccaggtacgctcgagctttaaaacggcgcaggcagaaaagacgatcggcaccattttcaatgagctgtttaaacaggcggtgaccgtcggcaaacgcacgcatgccgaaaccgatatcggctccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggtatcggcaaagtaacggtcatcaacagaacgtttttgaaggcaaaagcgcttgctgaccgtttctccggagaagcgcgcagcttaaaccagcttgaatatgcacttgctgaagctgatattttaatcagttcgacaggcgcgagtgatttcgtcgtgtctaaagaaatgatggagagagcgggcagacagcggaaaggccgtccgttatttatggtggatatcgctgtgccgagagacctcgatccggcgcttaacgatcttgaaggtgtttttctgtacgatattgatgaccttgaaggaatcgttgaagccaacttacaagaacgccgcgaaaccgctgaaaaagtcgagctgtttattgaagcggcaattgttgagtttaagcagtggcttaatacgctcggcgtcgtgccggtcatttcggcgctgcgtgaaaaggcgctgtccatccagtccgatacgatgcagagcattgagcgcaagctgcctcatctgacggtgagagagaaaaaacttctcagcaaacatacgaaaagcatcattaaccaaatgctgcgcgacccgattctgaaagcgaaagagcttgcggctgaagcggattcagatgaaaagctgaagctgtttatgcagattttcgatattgaggaagaggccggccgccagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctggaaaaatagccttctggttgctttctattgtctggactctgcaaactgtctatctttcttatttcatgtggcagacgggcagatttccggtcttgaatattacagaggccctttacttttatgcgtgggtgcttgtcacgctttcacttgtggtcacgcagattctgcgggttgattttatcgtgtttttcacgaatgtcatcggtttctcgatgattgcgatccatacgttttcaccgacggatcagcattcggccgccttttccggccagctggtctcagagcttttggtcattcatattacaatggcgattctgtcttacggcgctttttccctttcttttgtcttttcgcttctttatcagtttcaatattctttattaaagaagaaaaaatggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgactcaaaagtgctcggctcgtttattgtgctgcttttatacagctactatttatatatcagaatgattaaggaactgcaggggaaagtggcggcgttatggaattcagcatgttttctcgtgctgatgattaattacttcctgctcggaagcctgtcacaattccattggttcagttaacgcacgcgcccaaacagattcgggaggaaagaaaatgagaacgattaaggtaggttccagacggagcaaactggctatgacccagacaaaatgggtgattaacaaactgaaggaattgaatccttcctatgactttgaaatccgggagattgtcacaaaaggcgaccgcatcctcgatgttacactgtcaaaagtgggcggcaaaggtttgtttgtcaaagagattgaacaggcgctgctgcatcaggagattgatatggcggttcacagcatgaaagacatgcccgccgttttgcctgagggtcttgtcataggctgcataccgaaacgtgaggatccgcgtgatgcgctcatttcaaaagggcatcaaaagctggacggcataaaagaagggggcatcatcggcaccagcagtttaagaagaagcgcccagattcttgctgaacgccctgaccttacaattaagtggatcagaggcaatatcgatacgagacttcaaaagcttgaaacggaagattacgatgctattattttagcggctgcggggctttcgagaatgggctggaaagatgatgtcgtatcggaattcctcgaaccggaccgctgtctgcctgcggtcggccaaggcgctcttgccattgaatgcagagagtcggatgaagagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcgggaaacgctgtgcggcgatgatgtctgaaaaaggagccaaagcactaatcgacagcgtgaaacaggagctcgaacaggatggcaaatgaccttcctttacaaggaaagaccgtgctcgtcacccggaacaaaagacaggcagcaccgtttcgaaaaaaagtggaggcgctcggcggaacggctgtttccgcctctctgatcgcttttcaggaagcgctcccggatgaatgtgcggacagtctgcgggaagacctttctgaaccgggctggcttgtgtttacaagcgtaaacggtgtccggttctttttttcctaccttgatcagcatggccttgcgcttccggaacggaaaaaaatcgcagccgtcggtgaaaagacagcgcgcgccctgaaagagcggggagcccggacggatgcgatgcctgacgagtatgtggcggaatgtctggctgatactttaaaacggcacgcatcagctgccgaacccgtttcattgataaagggcaatttatcacgcgatgtcataaaagcggagcttgagccgcttggctatcaaataagggaatgggtgttatacaataccattcaggatgaaaaaggcatggacgagctgagacgggctgcatcccgctctcattttgattttattacgtttaccagttcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacctatacgattgaaggcatgctggacgtcatgtgcagcatgtcgggaaaggatagataatgatgaatcaaacatttaacagacaccgccgtttgcgcgcgaacgctgcgatgagagatctagtaaaagaaacacgtcttcacccttcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggtgtgccggaagaaaaagacgcctgcggaacccaggcttttcacgatcatggcattgtgcagaaagggattgctgaaattaaaaagcattatcctgaaatgatcgtcatcgctgatacatgtctctgtgaatacacggatcacggccattgcggggtcgtgaaagacggagtaatcctcaatgacgagtcgcttgagctgctggcgcagacagccgtcagccaggctaaagccggcgctgacatcatcgctccttcaaatatgatggacggttttgtcacagtgatcagggaagcgctcgacaaagaaggattcacgaatattccgatcatgtcttatgccgtgaaatattcaagtgaattctacggcccgttccgcgacgcggctgacagcacgccgcagttcggtgaccgaaaaacataccagatggatccggccaaccgcctggaagcgctacgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagcggcagcccaaaacggctggattaaagaaaaagaaatggtgctggaaattttaacgggcatgaaacgtgcaggagccgatctgattatgacgtatcatgcaaaagacgcagcgaaatggcttgctgagtaacgatttcatttgacgggagctgaggcagatgagaagctatgaaaaatcaaaagccgcttttaaagaagcgcagaaactgatgccgggcggagtgaacagcccggtgcgcgcgtttaaatcagttgatatggacccgatctttatgcagcgcggcaaaggatcgaaaatttttgatattgacggcaatgaatatatcgactatgtgctgagctgggggccgctcattttgggccacacgaacgacagggtcgttgaaagcctgaaaaaagtagccgagaacgggacaagtttcggggcatctactgaagtggaaaacgaactggccaaattggtcattgaccgtgtaccgtctgttgaaatcgtgcggatggtcagctccggcacagaggcgacaatgagcgccctgcgtctggcaagaggatacaccggccgcaacaaaattttgaaatttgaaggctgttaccacggccatggtgattcgctgctgatcaaagcgggatccggagtggcgacactcggcctgccggacagcccgggcgtgccggaaggaatagcaatgaatacgattaccgttccatacaacgacttggaaagcgttgcactcgcattccgggagtacggtgaagatattgccggggtcattgttgaaccggtagcaggcaatatgggcgttgttccgccgcaggaaggctttttacaaggacttcgcgacattacggaacagtatggcgcgctgctcatttttgatgaggtcatgaccggttttcgcgtggattataactgcgcgcaagggtatttcggcgtgacgcctgacttaacgtgtctcggcaaagtcatcggcggcggtcttcctgtcggtgcgtatggcggaaaagctgacattatggaacgaatcgcgccgagcggtccgatctaccaggcgggaacattgtctggaaatccgcttgccatgacagcgggacttgagacgttacagcagctcacacctgaatcttaccaagaatttgtgaaaaaaggcgatatgcttgaagaaggcatttcaaaagcagctgcagcacacggcattccgcacacgtttaaccgggcggggtcaatgatcggcttctttttcaccaatgagcctgtcattaactatgaagcagccaaatcttctgatttaaagctgttcgccaagtattataaagggatggccgacgcaggcgtatttctgccgccgtctcaatttgaaggattgtttctctccactgcgcatacaatggaggatattgaaaataccattcaagccgctgagaaagtgttccaggcgatcagccgctgataccgaaaagccgatgcaagcaagacttgtatcggcttttttcaatgcctccattatcatattttcccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgatagggagctgaggcatgtagaggaagtgagggcgagggaggatggcacggccgagctcattcattgtttcccggtggacatcacgattccgaaaaataaagtgagccacctcaatgatgttttcgtatttattgatgcctttgattatcagctgacggattcaaggatcttaaccattcaagctgatttggcaattgaagggctgcttgaggaatccgagccgaaagagccggagatccctttgtacgtggcgcctgaattttccagagaagaaatgatcaatcttgccggacatcattctgaggacgaaaatgaaccagaattaatgatacgccatgagcctgaaatacctttgactgtatcagaagaagcagcacaagaaacagagaagaacgaggaagaaatcccgcctttactcaggcaggaggaagaagagcaggaaacagccccgattctgagggagcgggaagaagaaaagcaggaaacagccccgattctgagggagcaggaagaagagcaggaaacagccccgattctgagagagcaggaagaagagcaggaagcagccccgcttctgagggagcaggaagaagagcaggaagcagccccgcttctgagagagcaggaagaagagcaggaagcagctccgattctgagggagcgggaagaagaagagcaggaagcaggcccgattctgagggagcgggaagaagaaaagcaggaaacagccccgattctgagggagcaggaagaagcgcaggaagcagctccgattttgagggagcgggaagaagaagagcaggaagcagccccggttttgagggagcaagaagaagaagagcaggaagcagccccgattctgagggagcaagaagaggtgcctaaacctgtttcctttactgagcctcctcctcccgtttccttccagcacgaagaagagccggaagaagctgaggagcctgcaatcatgtcagctgtgaggaatgaacccgtatttgaggatgattcagcagaagtgcaggaagagccgaaagatgatatcgaaccggttttccctgctttcactctgactccgcatgcagaaaaaccaaaaattgcggaacagcccttccttcaaaaagaagagcagccagaggccgagccgcttctccgtcagagcgatcataaggcggcagaagacgaagatgagcctgcggtttttcaagaggagcaggcgcccgtttatcgcgagttcgttccggaacggcaggaagaggagttttacagcgctcctaagctgcttgaagaagaggctcatggtgaagaagggtttgaaattgaggtaaggaagatggcgccgccggaggaggaaaccgggaagcctctcgatttgtcttttcagttttccaaactgccgcctgaggagccggcgcaagctgaacagcctgagccgcttaagcctgaaagaaagaatgaagaagcggcaccgggaaccgagcagaaggaaaatgacaactctcattacttgacaaaattatttacaagggaagaagaaaagttttcaagaatgaaaatttgtatcgtgcagcagcaagatacaatcgaccgggtgtgtgaacgatatgacattacatcccagcagctcatccgaacgaatgctttatcgtttgatgacgagcttgaggaaggtcagcttctgtatatacctgaatataataacagccatgtgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcggggagacagacggagaattcttattatttaatgccttggcttcagtacgatcaggaggaagaacgggatcaaaaacatgtttacctttttaaagaggtcgcgaagctccattctgcgactgtgcgggacatccaaatccggactgaagatatcagcggcttttatgaagcaacgaaaagagattgggaaaatgataagcttgtctatgaacaattcgccgaccgggcggaaaaagagtggtacctttcaccttttgaactgcaggccgttacgtatcttacagaaacggtttccgccgtcaattttgctctggaacgtctggaagaatggtttgacgcggcaaaggatcatgacaagacgagagcggtgatcaaccacggcagtttatcgagccgccactttctgtataatgatgcgggatcgggctttttcacgaatttcgagaaagctgcgctgggccctccgcaaaatgacctgctcggcttttactccagaatgttcagaagctatccgaaagcatgtccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaatgttgagccttttctcatgaaggttcatcagattgagcgggagaaaaaaataaaagcggaaaacgagtcctcttcataacaggactcgtttttttatatccattccaaatgcagggcgcacgctaaaaacagcaggatggcaagcagcaggacatcaaaagtcgtcggaaagaaaatcgtcctgatcccctgaaagatcgtaatcggaataatgacttgcacggatacaaggcggacctgtctggcccactgggggagcgaataagaattgaatttttttctcacgggcaattcctcctcacattcgcctttctatgtatcgtatgtaaggggaagagcggggtgcatgcccatttatgtatgacggcagcggtttttggaaaagatgattgacgaatcaaaaacacttttactataataaagaacataataaataagatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatattttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgacctcggccgtgaaaagtttttagaagaaacgtggaagtggaaagaagagtatgctgatttcatccgcagccaatgggccaagatgggactcggactcgattattcacgtgaacgtttcactcttgatgaagggctgaacaaagccgtgcgtgaagtattcgtcaagttgtacgagaaaggcttgatttacagaggcgaatatatcatcaactgggaccctgccacaaaaacggctttatccgatattgaagtgatttacaaagacgtacagggcgcgttttatcatttgcgctacccgttagcagacggttcaggctcaattgaaatcgcgaccacccgtccggaaacgatgcttggcgacacggctgtcgcggttcatcctgaagatgagcgctacaagcacttaatcggcaaaacggtgattctgccgattacaaaccgtgaaattccgattgtcggcgatgattatgttgatatggaattcggatcaggcgccgttaaaatcacgcctgcccatgacccgaatgactttgaactcggaaaccgccacaatttagagcggattctcgtcatgaatgaagacggaacaatgaatgaaaaagcgctgcaatataacggcatggaccggtttgaatgccgtaaaaaactcgtcaaagatcttcaggaatccggcgttctctttaaaatcgaagaccatatgcattctgtcggccacagtgagagaagcggcgccgttgttgagccgtacctgtccacacaatggtttgtcaaaatgcagccgctggccgatgctgcggttgaccttcaggcaaaagaagagaaggttcacttcgttcctgaccgtttcgagaaaacgtacctgcactggatggaaaacatccgtgattggtgtatttcccgtcagctgtggtggggccaccgcatcccggcttggtatcataaagaaacaaaagaagtgtacgtcggccttgaggcgcctgaggacagcgaaaattgggagcaggattcagacgtgcttgatacatggttcagctccgcgctttggccgttttctacaatgggctggcctgatgaaaacgctgaagactttaagcggtattactcaaccgatgtacttgtaacgggatatgacatcattttcttctgggtatcccggatgattttccaaggtcttgagtttaccggcgagcgtccgttcaaagacgtgctgattcacggcttaatccgtgacgagcagggcagaaaaatgagtaaatcccttgggaacggcgtggacccgatggatgtcatcgacaagtacggagcggattccctgcgctacttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagacgtgacacagcttgcggatcgttatgaattcggtgaagtcggacgccacctgtacaactttatctgggacgatgtgtgcgactggtatatcgaaatggcgaagcttccgctgtacggggaagatgaagcggcgaagaaaacaacccggtctgttctggcatacgtgcttgaccagacgatgcgtcttcttcacccgtttatgccattcttaacggaagaaatctggcagcaccttcctcatgaaggcgagtcaatcacgatcagctcttggccggttccggtgccggaacatacggataaagaggcagcggcggatatgaaactgctcgttgaattaatccgttctgtccgcaatatccggagcgaagtcaacacgccgatgagcaagcaggttgaactttacattaaaacatctaccgaagacattgccggccgccttgagaagaaccgttcttacgttgaacgctttacgaatccgagcacgctgaaaatcgggacggatatcgctgcggcagacaaagcgatgacagctgtcgtcaccggagcggaagtcattctgccgcttgaagggctgattaacattgatgaggagatcgcccgtctgcaaaaagaattcgacaagctgacaaaagaagtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcaaccgtttcttttatccgttccgtccttcaagaagccggttatacggtcggcacgttcacatcgccttacatgattacgtttaatgagcgaatcagcgtcaacggcacgccgattaccgatgaggaatggagaacgctcgttaatgacataaaaccgatagtcgatgagcttgataagaccgatgccggaacggtgacggaatttgaaatcattacagcgtgtgcatttttatattttgcgaagcgggctgatatcgattttgtcatttttgaagcggggctcggcggcacatttgattcaaccaatattgtgaaaccgcttctgtcggtcattacaagtatcggacatgaccatatggccattttaggcaataccatcgaggagatcgccgggcagaaagccggtattattaaaaattccattccggtcattacgggcgtcaatcagccggaagcactcggcgttattgaagcggaagccgaaaaaaagcaggctccgtatcagtcactatataaaacgtgcagactgtttaatgaagcggcgcttccgtccggcgaaagcttttcgctggaaacagaaacgaaatgctatgaaaacattcaaacgtcgctgatcggcattcaccaaaggcagaatgcggcattggcgatattggccgctgaatggctgaatcgcctggaggccgcagtcatttcagaagaagcgatgcgaaacggactgggaaaatcttcctggccgggccggtttgaacgtcttcaaagccgccctttagtgtttgcggacggcgcccataacgaagagggtgttgaaacgctgacagaaacgatccggcagcgctttgccggtaaaaacgtccatgtcgtattcagcgcattaaaagacaaaccgtatcaggaaatgattaaaaagcttgaaaccgaagcggattccattcactttgtatcatttgactttccgcgtgcttcaagcgccgaagccctttacaatgcaagcagtcttgcatctaagagcttcgatgagaacccggacagtgtgaaagaatggatagaacaaaaagacggggcggatgatgtcatcatcattaccggctccttatattttatttcagagatgagaaagcggcttatctgacagcctctcggatgcccggcagaccattttccggttttgccgggtgtttttatgctgaaaatatattttcagccatttcagtcatggtgtttttctttgctataatctgagccagattgatagtaaaggtgtggtctgagtgcttttaattctgttttttctcggcttgattttcggttcttttttttatacagcagcgtgccgtatcccgctgcgaatctcggttatttcgccgcgttcatcctgttcgttttgccgcttgccgctctcctggggggagcttgtgcccgtcgtctcctatattctgcaaagaggcagatgcagaaactgccgtgcgaagctgtcggttatgtatccggcggcggaatgctggacggcgtgtttattcacggctgcaggcattcatttcggtttctcaaaagaactgttagtcgcgctgttatttctgtctctcctcatgattgttactatgacggatctgcaatatatgctgattcctgacaaagttctgctgttttttcttccgcttttcatcgccggccgaatgttttctccgctggattcatggtatgcagggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagcggtatacggtatgtgcgctgcagcccggggcagtcttggtaaaaagcagccatttccgtttgcgccggccatctcagccgggagcgctttgagttatttatacggtgatgagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaggtacggccaagacgaatgcaagggggaagagacgttgaaaaaaaggaagagcaaaaagcacagcaaagctaaaaacaatgcccttaaagtaaccattaacggacaagaagaaacgatgtatggacaagaagatgtgaatgaaggcggggagaagaccgtcacattttccaattgggaagaaacaaaaaaggcggaacaggagaccgccgcttcccatgaagatccgaaagaagaagatttcaattgggatcatgagaagaattctgaggtatttgaagatgacccgaaagtcgttccgccataccagaagaaaaaaacaggccctcattttccgaaaaaaaagcagccgtcttctccagttaaaaaagcggtcacgacaattgccgttgcggctgttttaggcaccgggctcggccttgtcgccttaaatatgtcgggaagtaaagaagcctccgctccggcatcagctgacaaaggttcacaagggcagacggtgaaagcgggagatgtttctaacgacaaatctgaaacagccggcacaggagatgcggaatcttcagcgggaaactataaaacatatgcggtgcaggccggaaaattttcatcagaaaaaggagcgcaaacgcttgttgaccagctgactgaaaaaggatactcggccgtctctctggcaaaagaagacggatacacatacgtgatcgccgggcttgcagcggaaaaaagcttatcacagcaattgggtcagacactgatagaccatgattttgaggcttggggcggaaaagagctcagctttgcggtcgattcagggctggaagactcttttaaacaggcatctgagctctccgccaaagcgattaccggcaaaaatctttcaaaaacggaagtggctgaagcggcaaaagcggcagacggcgcagacgccgctgacaaaaagcagaaagaggccgtgcttcaagcgctgaaagaactggaaacgtcgggttcggaatccggctggaaagcccaaaaagagctattaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaaccatgacaaaacgcttaatactcgcatcacaatctccgcgaagaaaagaactccttaatcttcttcagattccttacagcattattgcgagccgcacagaagaaaaattaaatcgaaacctttcgccggaagaaaacgtccaatgtttggccgagcaaaaagctagtgctgtattggccgaaaatcccgatgcagtcgttatcggggctgacacgatggtgtgcatagacggcgagtgcctcggcaaaccgcgtgacagggaagaagcggcacagatgctgcggaggctttccggccgaagccatcaagtcattacggcggtcagcattcagacgcgtgaccggaaagaaacattctgtgacacaacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgcctgttaaaaggcgcctctgcccaggagctttccagcattccgggaatcggaacggtgaaggccgttcagattcttgccgcaattgagctggggagccgcattcataagacatccgccggggagcattgcgtcatccgctctccggaagacggggcgaagtatgtgatggaggatatgcgctttttaacccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcataatcatccttcaggagatcctacaccgagcagggaagatatagaggtaaccaggcggctttttgagtgcggaaatttaatcggcatcgagctgctggatcatttggtcattggtgataaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggtaaaggaatcgtagtgagagagccgtctgtcgttgctctgcaaacggatacgaagtcaatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccgtacgttatggtgtgtgtgccgtcaggtattacggccgttgaagaacgggcggtcatcgacgcgacaagacaagcgggcgcacgtgacgcttatccgattgaagaaccgtttgcggcagcaatcggtgcgaatcttccggtatgggagccgacgggcagcatggtcgttgatatcggcggcggaacaactgaagtggcgatcatttctttaggcggcattgtcacgtctcagtcaatccgcgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaatccgaggccgcgatcttctgacaggtctgccgaaaacgatcgaaatcacgggaacggaaattgcaaatgcactgcgtgatacagttctctcaatcgttgatgcggtgaagagcacgcttgaaaaaacaccgcctgagctggccgctgacattatggacagaggtattgtattaacagggggaggcgccctgctccgcaatctcgacaaagtcatcagcgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcacaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagaccctgaaaatgaccatccttgaaccggatgaaaaacgtgaagtgaaaaaaggcgacctcgtggagacctccggaacgggcggcgtatttcctcaagggctgacggtcggcgaagtgaccgatgtagaatcagatgcttacggcctgacgaaaatcgcttatgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtcggcttatatcaaccaaaagcatgcggtgatctacggtttcattttcggatttctttatgacatcaattatacgggtgttttaggcgtttatatgtttggttttgccggattatgctatctggcggccaaagcgtttaaagtgctgcagacaaacgccctgatggtcattctggtcgcggtgctgagcgtatgtgtgcttgaattttacgtctacggcattcagacgttaatccgcagcggcactatgacgtttaacgattttgtcattcagcgattcttgccgaccgctttgctgaatatcgcgggagccgttatattagtcctgcccttcaggctgttttatataagtctgaagaaagaattaagagatgagtaaaaaggattttatctttttttgacgaaaagagtatgttgttgaggtgaacattgatgaagaccaaaaagcagcaatatgtaacaataaaaggaacaaaaaacggcttaacattgcatctggatgatgcgtgttcttttgatgagctcctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttcggtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatccgaaatgatgccgacacaattgaggatcaatcacgtgttaaatcgctccccagaccacattcaaaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtagacacagatatcggactgcgcaaccttgatgtcgtaatgggtcttgaaaacagaattatttacgacttagtagatgtaattgaaggccgatgcaagacgcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggcgggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgtatcagaaatcacctggtgaaaaacggtgacacgatggatgtggatgaggttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaatcaagtcatttttcggcgtgcgttcataatatataccagaatacaaagatctgatgaagcccagcttatcaggtcttttttgttttttaagagcgcatatttgcaatggacaagacataggatgtacaaacccaacgattgcaaaggatgatggcgatgagtcacagagctgatgaaattagaaaaagactggccaaaagaagaaaacagcggcctgaatcaaaacggactttcgttcaaaacgctcaaacgcagaattttcccgcgtggcagacggtcaaggagcaggaaaagcacaagcttcttccggactacgaatatcaaacggaacacccgcccgaatttaacgggcggcatccattgatcagcgctcattctattattttaaaatgcctgctggccgcctgtctcgtactgatctccgctattgcctataaaactgacaaacagccgctgagtcagatcaaaccggcaatcgcacaaacctttcaaaaagaatttcagtttgctgccgtaagcaattggttcgtatcttccttcggaaacccgctcgcttttcttacgccgggaacgaaaaagaaggacggtcaggtggcggtcagtcaggatatggccgttcctgccgcggggaaaatccagcaggactttcaaaataacggagagggcgtcgtcgtcgaaaccgccagtgaagccattgacagcgtaaaagaaggctacattatggaagtgagcaaagataaaaaaacagggctgacggtgaaggtgcagcacgccgacaatacaagcagcatttacggccggctgaaagatgttaacgtttcattgtacgattttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattatcatggggctcggtcttatgacggggcacatcaaagcgctgctgtgtcttttgctggtcgtatccgttcatgagctggggcatgctgctctggctgtgtttttttcgtggcgcattaaacgcatctttctgctccctttcggcgggacggttgaggtggaggagcacggaaaccggccgcttaaagaggaattcgcggtcattttggcgggcccgcttcagcatgtgtggcttcaggcggcagcctggctctttttcacgtcaggttttgcaagtgagcagacatttgagatgtttaccttttataacctctccattcttttcatcaatcttttgccgatctggccgcttgacggcggcaagttcgtgtttttatacttctctaaacaaatggcttttcaaaaagcgcatctcctcagcctgcagacatcggccgtttccgcgcttttgctctgctgctggattgtgctggccgtcccccttcaggtcagcgcatgggtgctgttcgtctttctcgccgcttctttatgggatgaataccggaagcggcattatattcagctgaggtttcttttggagagatactacggcaaaaaccgcgatgtcgccatgctgcatcctttgacggtcgcggccgatgccaaagtaaagcatgtcatggctgaattcaaacggggatgcaagcaccccattatcattgaaaaagccggcgaaaagctcagccagctcgatgaaaatgaagtgcttcatgcgtattttgccgataaacggacagattcctctatggaagacctgctgctgccttactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcattttgtcctttgaaatgacgggacatgccgattttgctgaacatggacgagatctcgtttgcgccggggtcacggctgtcgttttcggagcggtcaatgcggttatcgcgctggctcctctcgaaccgattcttgatataggcgaggacgggggttatttctattttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcgtgagtgaaccccgccttgaatgaggacatcagcttctcatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgaactgatccaattaatgggccatttccgtcatgattggatgaataagctgcagctgataaaaggaaacttaagtttgcagaagtatgacagggtcgttgaaataatcgacgaaatggtcatagatgcaaagcacgagtcaaagctctcaaacctgaaaaccccgcacttggcgtttgactttctgacatttaattggaagtcccgttatatgaggctcgaatacgaagtgctcggagaaattaaagatttatcggcatatgatcaaaagctgtcgaacctgatgagaaaactgtttcatctgttcggtctggcggtaagcaatgaaagtgaaaatcatctgaccgtatcgctgcagacggatcaccctgacagacagcttattgtatatctcgattttcatggaacgattgcaaatgcagatgtgtttgatgaatttcgcaaatcccggtatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcgccatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcgaccccggccaacccggcgccgcagctgtcagaacacggagagcccggaaaagagcgctatatcgtgcttgaactgaaagtgcttgcagacgtaggtctcgtcggcttcccgagcgtcggaaaatctacgcttctgtctgtcgtttcatcagcaaagccgaaaatcgccgattatcattttacgacgcttgttccgaatctgggcatggtggaaacggatgacggaagaagcttcgtcatggcggatctgcccggtttgattgaaggagcgcacgaaggagtcggcttaggccaccaatttctccgccatatcgaacggacgcgcgtcatcgttcacgtcattgacatgtcagcgatggaaggccgtgatccgtatgaggattatgtgaccattaatcaggagctcagtgaatataatctgcggctgacggagcgtccgcaaattatcgttgcgaataaaatggacatgcccgaagcggctgaaaatctaaaagcgtttaaagaaaagcttcaggatgaccatcctgtcttcccgatcagcgcggtgacgagagaaggactccgcgatcttctgtttgaagtcgccaaccagctggaaacaacgcctgaattcccgctgtatgatgaagaagaactggcggaaaaccgtgtaatgtacacgatggaagatgaagaaattccatttgacattacccgtgatccggacggcgcgtttgtgctttcaggtgacagtctggaacgtctctttaaaatgactgacttctcccgtgacgaatccgtcaagcgttttgcaagacagatgcgcggtatgggcgttgatgaagcgctcagagaacgcggtgctaaagacggcgatatcatccggctgctggaatttgaatttgaatttattgattaaaaagacggagagcttgcaatgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagaaagttgatttaagcagaagcgctttttacaaataccgagatgcggttttccctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggagggctcggttaacttaacgattgactacttgattcatgagcagcctcttgcgatcgtgggggaaatgacgctgccgattcaccagcatctgctcgttcacccttcgagagaaaatgagtggaaaaagcttgagaaaatttattctcattcccatgcgattgcgcaatgtcacaaatttcttcaccggcatttttcgtccgttccttatgagtatgcgaagtcaacaggtgcggctgccaagtatgtcagtgagcattcggaccttccgatcggcgtgattgcaaatgaaatggcggccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggcgcgctgcacagggtgctgtccgctttttcatggagaaacctgaatttatcaaagatcgaatcgcgcccgaccaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagctccccttcagggggctttttttttaatcttttattaaaatacccgcgtcgtccagcgcttgacaggcttggtcaatccgctcttttgtcggggcgcttaacgtatggagatgcacgcctccggtcagctgtgaaaggtaagcggcatttgtcgagttaatgtgatccatgaattgtttgacttctttccgtgtgctgactcttatggcggcggttaaatcgccgtatacggggtgttcaataatgacgtcctttatggtgacgccttcatcgacaatgagttcaagctcttcttccgtccgctccgggccgtgcagacaggcgacaatccgttcggcgtttttttcgccgccggcattcatgctgatgtataaatagccttggctcgtcgcgataatcggttcgctttttgctttcaagagcgatatgtcctgcacgatcacctgtcttgaaacatttgcttttttggccaattcgcctcctgttaatggcgagccggcttctttcagccaatgaagcagcatgtcgcgtcttttcgccccagtaagcttcgttccttctgtcaaattgctgattctcctttcttttgctcccatagcgccgtaaatgtatgtatcagcatatcgagctgttcacatgttgtttcgtttccgaatgagatccggaaaaactgccgcgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgccggtttcttcctctgaaaatgaaatggggaggccttgacgcctaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccggattccagctgacacccggccgaatgtaaacagccccggtgcctttcgggccgtatactttatgaccggagacggaaagggcgtcgattcccgcctgatccgcatcaatcggcagtttgccgaaactttgaacacaatcgcaatgcagtaaaatgtttctctggtgaagaaaagcggccagacgattcacaggctggatgaggccggtttctgaattggcgtgctgtatggaaacgagccccgtgtcaggacggatatgagccgccagtatgtcctcggttataaggccgttttcgtcgggatatatgatggtgacatcaattccccggtcagctaaaaacgccgcggcattatggatcgagtggtgttccattgcggtcgtaataaaatgttttttatgatcgggcagaccgtacagcaatgattggacggccaagatgttcgcttccgttccgccgcttgtaaagtgaatgccgtctgccgctccgccgatcaattttcctgcagaatgtctgcaatattccagcacgtccgccgctcttcctccggcgtcatgaaggctgctagcattgccgtatacctctgtgctgagatgctgaaagactttcgcggcttctttgcttaaaggcgttcccgccgcgtaatcaagataaatcatacagcccgtctcctatccgtttatgttaaaaaaagcttgagtttattttatcgttgtgtaaatataggtgtcaagacaggtgtaaatataatgggagggtgatgtatgtctgaaaaaacaattatcgtcattggtacggggacggcggcccttgcctgtgcttcctcatttcctccgtcataccaagtaaccgtcatcacaaagagaaacgtaacgaacagcaattcgtattatgctcaaggcgggattgctgtttcatacgcaaaagatgactcgatagaatcccatgtgaacgatacactgtatgcgggatgcggacacaatgacgtgacagccgtgcggcatttgctgcaaagcggacagagcatgataaacaggctgatagaaggccttttcccttttgatacgaagtcggacggaacgttttgtctcggcagggaaggcgctcattccaaaaggaggattctgcacgccgggggagatgcgaccggacggatgctggttgagtttctggttcggcagctgagggacggcattcggatcattgaacacgagacggttgttgatctgctgattgaacacgggcgatgcgcaggcgttgccgtaaaggatgcttcaggtgccgtttcttacagaagagcggattgtgtagtgcttgcttcaggcggctgcggcagtctgtaccaatatcacacaaatgattccgccataacgggagacggcatcgctcttgccttccgcgcgggagctgagatcacggatatggagttcacccagttccacccgaccctccttgtgaaaaacgggactgtttacggtctgatttctgaagcagtgagaggagaaggcggatatttagcagatcgcttcgggcgcaggatcatggctggcagacacgcgcttgaggatttggcgccccgggatgtggtttcacgggcgatttatgaagaaatgatgaaagaaaatcctgtttttataaattgcagccgaatagccgattttaacaaacgttttccgaccataacagaaatttgtcaaacagccggcgttgatcttgaaagcgggatccccatagcacccggaatgcattttttaatgggcggagtaaaagccgatacatgggggaaaacgtccgtgcctgatttgtacgccataggcgagaccgcctgcacaggcttgcacggggcgaaccgccttgcgagcaactcactgctggaagcgctggcaagcgggcaacgatgtgctgaacatatcattcaaacaccgttaaacggaagatataaaaaaaccccgaagaaaactgatgtcatcttacaagtgccggacacaacgattcatgtgcttcaagccaaaatgacaaccggagcgggtatcgtcagggaaaaagaaaacctgcaggcgctgacatcctggcttaacaacgtatctgtgcatcatataaatgtgaaggatatcacaatggaacaagcagagctatcctgcctatggaagactgcgcaacttgttgtcacctcagcccttattcgggaagaaagcagaggcgctcattttcgtactgattttcccgggacggagaaagattggcacggaaaacaaatcattcattcaacatctggaacggttatcagaaaaaacgaaaggattggggaactatggacattctgcagctgaaacaaatgctgactcatttttttcaggaagatatcggaacgggtgatgcgacgtcacaagcgattttttctgatcagcaatgtaaagcgcggatcatcgcaaaaacagacggcgtgtttgccggagaagacgttatccgtgaaggatggaagcttttacacgatgatatccgcatccgccctctgaaaaaagacggagaacggatgaaaaaaggagatgtgctcgctgaaatggaaggccgggcggcagctcttcttactggggagcgggtcattctgaatctcatacaaagaatgtcaggcattgcgacaatgacggacgaggctaaaaggcgtcttgatgatccgtccattaagctttgtgatacgagaaaaacgacaccggggctcagaatgctggaaaaatacgccgttcgggtcggaggcggctttaatcatcgcttcggcttatatgacggcatcatgattaaagataatcatattgccgcctgcggatcgataaaggcggccgtggagcgggcaagagaaacggcagggcagatgcttgcggtggaagtcgagatcgaatccgaacagcagctgctcgaggcaatagaagcgggcgcagacattattatgtttgacaactgtccgcctgagtccgtccggcgttttgcaggcatgacaccgggccatatcaaaacggaagcatccggaggcataacgctcgacacattgcccgcttataaagggacgggcgtccaatatatttcactcggatttctgactcattcagtaaaaagcgccgacatcagcatggatgttgaggctgcggaacagggggatttttaagatgtctatttttgacgtgttaactgcatcagccgaaatgatgccgagccattataaagacatgagcaccggagaaatggaaaagcgtgtcgccgccattaaacgggatttcggaaagcgcctgttcattccggggcatcactatcaaaaagacgaagtgatacaattcgccgatacggcaggtgactccctgcagcttgctcaagtggcagaaaaaaataaagaggcggaatatattgtgttttgcggcgtgcattttatggcggaaaccgctgatatgctgactgatgataaccaaaccgtcatattgcccgacatgcgcgccggatgctcgatggctgatatggcagatattcagcagacggacaaagcatggcaagagcttcaagaactgtacggtaacaccatcattccgttaacatatgttaactcgacggcggaaattaaagcattcgtcggtcggcacggtggagcgaccgtcacctcttcgaatgcccggagtgtgctgaaatgggcttttaaacaaaaagaaagaattttatttttgccggatcagcatttaggcagaaatacagcctatgacctcggcattccgctgacagaaatggctgtatgggacccggggcagaaccgattgcttactgaccatccggaaaacattaaagtcatcctttggaaaggacattgctccgtacacgaaaagtttacagcggaaaatatttttcagctgcggcagcgggattccggcatccgcattatcgttcatccggaatgttcgcgggaagtggtctcgctcagtgacgacagcgggtctaccaaatatattattgatacgattgaacaggcagaaccgggaagcaagtgggcgatcggcacggaaatgaatcttgttcagcgcctcattcactcgcacccggataaacagattgaatcattgaatcccgatatgtgtccgtgtctgacaatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacccaaggccggcttcggaacgtctgcgcataagcatgagcatccatatgccaaagaaaaaccgaaatcagttgtggacattgaagacaccataccggaagaaccgaagccgtcaattccgtatgtgccgccaatccctgaaaagcatgaaaatgtgctgccggaagctgatatgaaccaatattatccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccgaaggcgcctgaagccggaaagatggaagaagaaaacgccgcttatcatctgccgaacatgccaaacattccgaatgtcccgtttccgaatatgccggccgttgaaccgccttttatgcattacccgatgccgtgcatgccttgtccttgtccggttccggtgacaccgatgctgccgggttcgggactatgccatccgtgcttcccggtaggcggaggtttcggcggttttggaggaggttatggaggctttccggtaatgccgatgccgttaccgtacggattccatcatcacggattccatcatccgggatttgggccgcaagcgggttacggtgaatatgaaaaccaggcccatgaaaatgcagagcattatgatggttctgcatccggtttcggcggtgctccgtacggtcaaatgccgtattacggcggatattcgtctcattacgcaaacgcgcctcatcatgatgggaaatttaaggatgatgattgcggctgccatgattcacatcaccaccaccatcatcaccacggttcacatcaccatcacgcaaatatgcctgtgcagccgtatccgaatgtgggtgcaaacgccggatattttatgccttacggcggagcaaatcctaatgccgcaccgaatcagccgagtccaaatcaagtattcggacggccggaggaagaagaagattaatgtttcgggacgatgtatgtcgttcctttttttatgtccaactgaggaatggacataactgacaagcttaaacccgccgtcggccgcacatcctaaacatgagcggaaaacgctcaaacagcgatgaatccacgggggtttttccattgggtaaaaaactgatgacgatcgcaggcgttttagccgtgacggcaagcttaacggcatgcggagcaaataatgccatgaatgacggacgctacaatcagtcaacacgtccggtcggatattattcgaatgataatgataacggcagacgccagtacggaatggaccatcaaggacccgtttctgaaatgatggaaaaccgaaacggccgtcataatacgacaaacgtgtctgaccagtatgcgcctaatgacggggttccgttaacgacggacggcacatataacggccgaaatgtcaatacgccgccggcagctatgtcttataatgggtatgacaacgccgaaaacatcaggctggcggcaaaagttgcaaaccgcgtgaaaaaagtaaaaggcgtacaggatagtcaggtcatcgtgactgacacgagagtcgtcattgctgtcagaacaaatcatccttttacgaaaaatgatgataaacatgtcaaacatgcggccaaaagatttgcggacggccgtacaattcaagtgtttaccgacaacgctacttttacaaagctgcaagacatgaacagaaacagccgttaaacgggactgccggatgatttcatccggcagtatttttatggataaagcttcatcatttctttacatattcttaaaacgctctttatgttgcggtgttaacataaaagtaataaaacgtaacggaggggccggaatgaaaaaaacggagcatgacaaaagccgcggagaaaaaactgtgtatctgaccgtaaggggataccggctcaaactgacgtccggacaaatgaaactgatttcagccggccgggcataatcatcggggcagccttcataatagaggctgcttttattcggctgaaacagacaaatgaaagaaaacggttaagcaccggcatctttggtcaaactagcatcaagagtttgattgaataaagaggtgttattggtgaaacgaatttgcggtgctcgtctattgtttatgcttatcttatcggctgcagtcctgatttgcggaggaaaaggcgcatacggggcggaggttgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgttcttttccgtaagcatgttgatgacatttctccgctcagtaaggttaacggttatatcggcgtcacggacggaggcgtcatctccacttttcacggccgtcccggatcgctggccgagccgatccaatctttcttccagattgatatagaaaggctggaaagccgattgcaaaagcacttggaacacggcataccgtacaggacaaaagcggagtttgagagcgtgatcgatcatattaagacttacagcggatgactttgacgcaagacatgtgacacatgtcttttttttctgaatggaagatgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtcttcactccgaacccgtttatttataaggtaagcaatcaagagaccatttttacgtatcatcatataaaagaagacgccttttctttgtacggtttttcaacccgggaagaaaaagcgcttttcacaaagctgctgaacgtcaccggcatcgggccgaaaggggcgctcgccatcctcggttccggtgaccccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagcgcttagggttctcggctacgccgaaaaagaaattaaaaaagtgcttcctcacttaaaagaggaaacggcgctttcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacgctggaccacgttcttttatacgggcctccgggtctcgggaaaacaacgcttgcgtctatcgtggccaatgagatgggggtggagatgcggacgacgtcaggtcccgccatcgaaagaccgggagatttggcagccatcttgacggcgctcgaaccaggggatgtgctgtttatagacgaaattcacaggctgaaccgctcgattgaggaagtgctgtacccggcgatggaggatttctgccttgatatcgtcattggaaaaggcccgtccgcccgctccgtccgtctcgaccttcccccttttacgcttgtaggagcgacgacaagggtcggattattgaccgcaccgctcagagaccggttcggggtgctgtcgcgtcttgaatactatacgcaggaagagctgacagatatcgtgtcaagaacggctgacgtttttgaagtggatatcgaagaagctccggctctggagatcgccagacggtcaaggggaacgccgcgggttgcaaaccggcttctcagaagggtgagagattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggaggtcccgtcggccttgatacgatttccgcgacaatcggcgaagaaccgcatacaatagaggatgtgtacgaaccgtatctgctgcagatcggatttctccagaggacgccgaggggacgggtcgtgactccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaataaaggtgaaatgatgaaagtcgatttatttgattttgaactgcctgaacgcctcattgcccaagtgccgctgaaagaacgtgacgcatcgcggctgatggtgctcgacaaacagacgggcgggctgacggacagttcatttaaagagattgtaagcttttttaatgaaggggattgtctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaagggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcatcgtgtcggtcgggacgacatcaacgcgcaccctggaaaccattgccggcgagcatgacggcgtatttaccgcttcaagcggctggacgtccatattcatttatccgggatatgaatttatagcgattgacggcatgatcaccaattttcatctgccgaaatcttcccttatcatgctcgtttctgcgcttgccggcagagagcatgttctttccgcctaccgtcatgcggtagaagaggaataccgtttcttcagctttggcgacgccatgctgattatctaatttgaagacaggaggcctcatacaaagtggctgaacaaccgatacgttatgaatttataaaggaatgcaaacaaacgggagcgcggctgggcagagttcatacgccccacggctcctttgagacgcctgtatttatgccggtcggcacgcttgctacggtaaagacgatgtctccggatgagctgaaatctatggatgcgggcattattttaagcaatacgtaccatttatggctccgcccgggacacgacattgtaaaagaagcgggcgggcttcataagtttatgaactgggaccgcgcgattttaacagattccggcggttttcaggtcttttcattgagcaagtttcgtaatatagaagaagaaggcgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctgttcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaaccccgcttttaccgaaggacaagccgagatatttaatgggtgtgggttcaccggatgccttaattgacggcgccatccgcggcgtggatatgtttgactgcgtactgccgacccggattgcccgaaacggcacggtgtttacgaatgaagggcgtctgaatatgaaaaacgccaaatatgagcgtgatttccgtccgattgacgaagagtgcagctgccatacatgccaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcatgaaaggagggaaacagatgggtactttaggcacaatcgttcctattattttaatgtttgcagtgctttatttcctgctcatccgtccgcagcaaaagcagcagaaggccgtccgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaaaagcaagatgattaatgaaaaacagacggcggttaacgctccgatcatccagcctttttccttcgctttgccgcccgatataaaacctcccgcaaataaagaaagaaaagaaagcgcggtgatcagccagctgaaagatgattcttccattgaggtgactgtcagtaaaagcgaaatcgccaaactcgtaagaagcatcaccgcaaaaatagccactaagccgtacaaaacgcctcttcccacttgtttcgtttcttccatttttatctcctctccgctctgcggcctgatatatgacaagccggagcccgtctttttctaaatgtattctctgaatgttcgaattagacgtaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacaattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtatcgtatgccattttggagtcttcgggcaaactgtcaatcgtcaaaaagaaaaacaataaggataagcagatggaaacatcgcttatcgttgacggggtcattcagaacgagcatctggacagaatcgggaaagataaacactggcttgaaaaaaatttagcaaaaagaggatatcgcgatctttcggttatatcattctgcacgtttacggacggcgctttttttattgatctcaaagatgaaaaaggggagccataaatcggcttcaccgcgtcacgaacttgccgatgaccggaatccggatcagctcttcccttttaatcagcctgaataacagcagcagcgcaatgtacaaaatcgcggtcattgcaatccagcctgtgagattaacagcctctgatcctgaaaaatgaacggtgtgcttgatgatgcggctgacataaccgcaaatgaatatgacggcaaaacagagcgcgtattcttttattttaatgctgatcggaagcaccttgcttacggtggccgcatgcagcagggtgacaaggaccatccccgttacaatcgcaagtgcggcgcccatgatgcctaaggaaggcctggtcgccaaaacaaaaattaggccggttttgacagcggcgccgataaaactgttcatcatggcggccccggctaaattgagagcctgcagcaccgcctgaagaggcccctgaaaatagtaaagcagaaaaaacggcgccatcactttaacaaataccgccgcattagttgatccgtacatgacggacatcagttcatcagcgaaagagaataaaataaccaccgaaatgcctccgcttaaaagacacagcctcatcgcctgttccagacggtattctacaacttgcagctttttttgctccattccttcactgatcgcaggaacaagcgccgttgacagagaataggttataaagctgggcagcgtcaaaaccgtcatggcaaatccggtcagctccccgtactggctggtggcggcagcggtggccactcctgcaatcgcaaggctctgcgcgacgacaataggttcaaaaaaccaagataaatttccgatgaagcggcttccggttgtcgggagcgacacgctcatcagctggcggaaggtttcttttccatttgcaatcgacttgaaaaattgttttctgattctgattgttttatttgctttaaaacaaatgaataaataaataagagaggcaagctccccgatgacagacgaaatcatggctcctgctgcggcatattcaatcccgtacggcagaaacaccgtcgtgcagactgcgacaagtgaaatccgcacgatctgctcaagcacttgggaaaacgccagcgggttcatattctgcctgccctgaaagtaaccgcgcagcacgctggatatcgcgataatcggcacgacgggcgtaatcgccagaagcgggaaaaccgtgcgctgatccgtcagcatcgtttctgacataatcggcgcaaagcataaaaacagcggcgtgaagatgagacttaatatcccggtgacggtaagcgccatcactaaaatgtgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcaatgagaataagagtgccccttaaaaaagtctgttttgccattttataaacccctgccttctcaaactacctggaatcatatacaataaagatatgcgccgatgtcgtccgagcatgacaagtcttcgagaaaaatggaaaaaggagcgagcgcccagtggagaaacatcccgccgaaatgtacaaagatcatttgcggcctttcttgtacagtaaacttgaagagttcaaaatccttggatacgatgatgttgagcacgagagtttatggtcatacttaatacataaaaagtggaaacagaaaaaggaattgccgctgcatgaattggccggtaatattttatcagttaaaattggcgattttatgaactatgcaaccgttgaagcttttaagtcgtctaattggctggaaagcgatgagggtcaggaagctttggatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaacattcagattgaaggaaataaccgcatacgcgttcagctggcgggcgtcacgaatcagaacagggcgcgcgaaattctgtcaacggaagcgcagctctcgttcagggatacgaatgataaagagctgttaaacggctctgatctcgtggaaaacggcgcgaagcaaacctttgatccgacgacgaacgaaccgattgtcagcgttaagctgaaggatgcggataagttcggagaagtgacgaaaaaagtcaagaaaatggcccctaataatcagcttgtgatctggcttgattaccaaaagggcgattcatttaaaaaagaagtcggcaaaaaacatccgaaatatgtatccgctccgaatgtgagccaggaattaaacacgaaggatgtcacgattgaaggtcagttcaccgttcaaaaagcgaaggacttggccaatattttaaacgcgggtgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtcattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaactgaaactcggcaaatccgtccgctcagctttccgttcagggaacagacggtcatttgcgacgatctttgatgcgaacatcacaacgatcatcgcagcggtcgtgctctttattttcgggacaagctctgtaaaagggtttgcgacgatgctgattttgtcaatactgacaagctttattacagctgtcttcctttcaagattcctgctcgcccttcttgtggaaagcagatggcttgaccggaaaaaaagctggttcggcgtcaagaaaaaacatattatggacattcaaaaaacagatgaaaatactgaaccgcatacggcattccagaaatgggatttcacgagcaaacgaaaatatttctttattttctcaagcgctgtaaccattgcgggaattatcatcttactggtctttaaactcaacctgggaatcgattttgcaagcggtgcgcggattgacgtgcagagcaatcatgcattgacggcgcagcaggttgaaaaagactttgactctctcggcatggatccggaaaacatcgtactctcgggtaaagagaaccatgttgccgcggcccggtttgtcggagagccatccaaagaaaaaatcgctgaaatcaaaacgtactttaaggacaaatacggatctgaaccgaacgtcagcacggtatcgccgacagtcggaaaagaactggcccgtaatgctttatatgccgtggcaattgcatcaatcggcatcattatttacgtgtcaatccgtttcgagtacagaatggcaatcgccgcgattgtatccctgctgtatgacgctttctttatcgtcgcgtttttcagcattacaaggctggaggttgacgtaacctttatcgccgctattctcaccataatcggttactcgataaatgatacgatcgttacatttgaccggatacgcgagcagatgaaaaaacgcaagccgaagtcatttgccgatctggaacatatcgtgaatctgagtttgcagcaaacctttacacgttcgatcaatacggtcttgaccgttgtgattgtggtcgtcgtgctgctcattttgggctcatcgtcaattacaaacttctccgtcgctttattggtcggtttattgacgggcgtttattcctctctttacatcgccgcgcagctgtggcttgtatggaaaggaaaagaatttaaagggaaaaaatcaatcgaagagtaaaaggaaacaggctgtcttccggaaggcagcctgttttttttaggccgcattgaacttaaaacctgcatttgctataatgacatacgcttacataatcaatcatcattgttaaaacatgtagggggttcttatgaacgttcgtgagtcggagcttccgggcatcggccagaaagtagaagtcattacgaaaaatcacgataaaatcagtattattcttcatgatgacggcagaaaagagctctattacttcgatgagaatgattatgacgaatgcttggcatccgttgaatttaacgacgaagaggcgaggcagatttccgctattttaggcgggatgacgtataagccgaaagcgctggaatctgtggaagtcgcgcttgatgacctcgtcattgagtggtttaaagccgaatctcatgcaccggctgtcagccgcacaatcggagatttggagatcaagaaacattacaacgtccagattattgcgatcgtgaagaaaaaccggcaaaaacagctgagccccggcattgataccgtaattgaagaaggggacaccctcgttatatcgggagaaagaagcggactgaaaaagctggtccgcgagcaattaacggcccggatttcctgagaccggggtttactcccgggaaaatgggggaaaagataagaatcaataattgggggcagacgcatgaataaacaatggactattatattcgctttactatttactctgattgtcgccatctttgctgtcattaacgtgcgggcggttgaggttgattatctgttcggaaccgctgaatggccgctgattttagtcattttaggctctgtgttaatgggagcgctgatcgtgttttcagccggtatatttcaagtgatgaaactgaagcgcgaaattaaaatgctgcggaaagaaaacagatccgcaggtgaattgacggctgattcggacggcaaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgttttacagaaggctacggcccgaatgaacaagctttccgttccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttgccggaagctatgctggacttggcggcaatcggtacggttgcagatctggtgcctcttcatgatgaaaacagattaattgcgtcactcggaattgaaaggcttcgtacgacaaatcggccgggcctcaaagctctgattaagctttccggcggagatatcggacaagctgatgaggaaacgatcggatttcaggtcgcaccgaggcttaatgccgtcggaagaatagaacaggccgatcccgctgtgcacctgctgatgaccgaagatcagtttgaagcggaggaactggcttcggatattgaccggctgaataaagagcggcagaaaatggtgaaaaccatgaccgaagaggctgttgaaatggtacagcagcaaggcggaaacccgtctgccattgtagtggcaaaagccggctggaatccgggtgtcgtcggtattgtcgcatcgaagctggctgaacgtttttaccggcccgctgttgtgcttgggatagatgaggagcagggaatcgccaaagggtcggcgcgaagcatcagaggcttcaacctttttacgagcctttcacagtgcagagacattcttcctcatttcggcgggcatccgatggcggccggaatgacgctgaaggctgaagatgtggcggaattaagggacaggctgaatcaaatggctgaagaaacccttacggaagaggattttattcccgttcaggaggttgatcttgtctgcggcgttgaagacataaccgttgaaagcattacagaattgaatatgctgtcgccgttcggcatgcttaaccctaaaccgcatgtgatggtgaaaaatgccgtgcttgatgatgtgcgcctgatcggagcgaataaaaaccacgtgaaaatgacggtgaaaagtgattccgccgtccttgactgcgtcggctttaacaaaggagagctggaagccggagttgttcccggatcaacgatttccattgtcggcgagatgtccattaatgaatggaacaacagaaagaagccccagctgatgattaaagatgctgcggtgccggaatggcagctttttgatattcgaggcaagcggacgtgggaagatacggtcaccgcactgccgaaggaaaaacgggtgctcatcagctttaacgaaaaaaccgctcagaagctccgtgaaaaagagctgacgggcgagcttgccgagatcacttcggaatccgaggcggaagctctccagcttgacggaaaatatgccgtttttctggatgtgccgccgtcagcggatcgcctgcagcatttgcttgacggaaagaagccggaacggatttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgagcggtgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaggcttatgaaagtacgaggaggacatagaacagatggatcttaaaaaatacgtaacaattgtgcccgattacccgaaagaaggcgtacaatttaaagatattacgacattgatggacaaaggcgacgtataccgttacgccactgaccaaattgttgaatatgcaaaagaaaaagaaattgatttagttgtcgggcctgaagcgcgcggctttattatcggctgtccggttgcatacgcactcggagtcggctttgcgccggttcggaaagaaggaaaacttccgcgtgaggtcattaaagtcgattacggtttggagtacggaaaagacgtactgacgattcataaagatgcgatcctgccgggacagcgtgtgctgattactgatgacttgcttgcaacaggcggcacgatcgaagcaacgattaagctagtcgaagaactgggcggcgtcgtagccggtattgcgttcttaatcgagctttcttaccttgacggcagagacaagcttgacgattatgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcggggatcctcgtcgatttggaaatggacccttccacaattgcgggcggatttctgcatgatgtggtggaggacacggatgtcaccctcgacgacctgaaggaagtattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgttggagattttcgctccgctggcccatcggctcgggatttctaagatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgttgaagaagtgaatattaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtactcggcattattcatacgtgctggaagccgatgcctggcagattcaaagattatattgcgatgcctaagccgaatatgtatcagtctctgcatacgaccgtaatcgggcctaaaggcgatccgctggaagtgcagatcagaacgtttgagatgcatgagatcgctgaatacggggtggccgcacactgggcttataaagaaggcaaggctgcaaacgaagaagcgacatttgagaaaaaactgtcctggttccgtgaaattctggaattccaaaacgagtctacggatgcggaagaatttatggaatcgctgaaaatcgatctgttttctgacatggtatacgtatttacgccaaaaggcgatgtcattgaactgccgtcaggctctgtgccgattgatttttcctacaggatccactcagagatcggcaacaaaacaatcggggcgaaagtgaacggaaaaatggtgacgcttgaccataagctccggacgggcgacatcgtcgagattctgacgtccaagcattcttacggtccgagccaagactgggtcaaactggcgcagacgtcccaggcgaaacacaaaatacgccaattctttaagaaacagcgccgtgaagaaaatgtcgaaaaaggccgtgagcttgtcgagaaagaaattaaaaatcttgattttgaagtgaaagatgttttaacgctcgaaaatcttcaaaaagttgccgacaagttcaatttctcaaatgaagaggatatgtacgcggcggtcggatataacggcattaccgctcttcaggtggccaacaggctcaccgaaaaagaacggaagctgcgtgaccaggaagagcaggaaaaaatcgttcaggaagtcacttccgagccgaaacattatcctcaagggagaaaacgggaagcgggtgtgcgcgtaaaaggcattgacaaccttctcgtccgcttgtcgaaatgctgcaacccggtgccgggcgaccatatcgtcggttttattacaaaagggcgcggtgtatccgttcaccgggacgactgtccgaacgtcaaaacgaatgaagcgcaggaacgtctgattcccgttgaatgggagcatgaatcacaggttcaaagacgcaaagaatataacgttgagattgagattttggggtatgaccgtctcgggcttttaaatgaggtgctccaagccgtaaatgaaacgaaaaccaacatctcctctgtctccggcaaatccgaccgcaataaagtcgctacgattcatatggcgatttttattcaaaacattaaccatctgcacaaagtggtcgagcggattaagcagatcagagacatctattcagtccggcgggtaatgaactaaaaggagcttgctatgaaattagttgttcagcgtgtaacagaagcgagtgtgacggttgacggcgctgtcgccggccggatcggacccggtattatggcgcttgtcggcatcactcatgaagatacagaagaagatgccgcttacttggcggataaaatcgtgaatcttcggatatttgatgatgaaagcggcaagatgaatttatcgcttttggatacgggcggggagattttatccgtttcccagtttacgctttacggcgaaacaaagaaagggagacgcccgaattttatgaatgcggctaaaccggatcaggctgtgctcctttatgaaaagtggaacgaactccttcgggaaaaaggagtcaaagtggaaaccggaatattcggagccatgatggatgttcagctgacgaattccgggccgattacattgattatggattctaaacaataaaaaagctgccgttcggcagctttttttttatgattgaaaataatgttccaatccgctttcaattccgtctgtcactttttcctgataagagccgctatgtatgattgtttcttcttgcggttgactgagatagccgagctcatacagcatggcaggccgtttattttccctcaggacgtaataatcgccaaacagaacgccgcgatcaggaataggggaacgcttcactacttcagaatggacgtctgaggcaagctggcggtccttagacggactgtaataataagccgtgcttccccgcgttgacgtatcggcataactgtcatagtgaatgctgataaaggcatccgcattccggtaatgagaggttgaaaccctggcctgcaggctgataaatgtatcatcctgtctggtgatatacacgtttgcaccggccgctctcaattttccggctaacagcttagctgttttaatcgttacgtttttttcaaactttccggagtagccgatcgttccgctgtcttttcctccgtgtccgggatcaacgacgatcgttttgtttttaagtgagccgctgccgcctgacgtgttgggagaaggtgcttcgcctgtttcctcaccgctttttgacgtttgtacgacccagtctgccacatatgcggtttgtccgttttcaagccggacttcataccatttgccgcttgagccgacaatcgggtaggctgcgcctttatctgccctttttacgatagaagcggaagtcgaggccgagctccttaagttggtgccgccgtaaacaatatacgcttttttcgaggagcctgagcccgcagaaccgtctcccgagccggatgcgctgcccgatgagtcagaatcctttatgatgtagtggcttgctgcccagcctttttgcccgtttgcttcaattttcagccagccgtggtcttcacttaagatggaaacctttgttccgcgtgataatttagtcataatcgctgaatcatgtgacgctgcacttctgacattcaatgaagaaacgccgaccgtcccgctttttgacccgcttcgggccgaagttgctttcgtatccgatccgccgctgtccgcggtgacgtattcggaagaaacccacccggttgtgccttgataagaaatgttcacccatccgctgttcttgtccagcacggatgcatgcgcgccttgcggaagtttgccgatgacttcatacgatgtccccgggccttttctgatgcggaggtcaggatcggtggaagtgaccgttccgctttttgcggatgaattgtctgctcccccggctgtttttgatatcagccaggaaacgacccatccggttttaccggggctcagctgaagctgtacccagtctccctcttctttaacgatcgggtatctttcccctttttttacttcagcctttattccgtagctcaggccgggaccgcctctgacattgatcttgtctgtcgcgatgaccgcttctccctctgcggcgattgcggtgtgaaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatgggacgcgcgctgcacgatgcggaaggaaatctgcacttcagtgatcagagcgatagagaaaaggcgggttttcttgaagagacggcgacggagttcggtctcttatcgaaagaagcggtcgcaaggaaaaacagacggaataaaacttgacaggggagtgcaatcccattattataatagaaattgatgtacataactcatgataacgattttgaaccgataatggagaagagtaggtcagaatgcatggaaaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattattcgcaagaggcgtcggtgagtctacagatatcgtgcagaaagaaatgtacacgtttgaagaccgcaaagggagaagcttgacgcttcggccggaaggaacagccgccgcagtccgcgcgttcaatgaaaataaattatttgcgaacccggtgcagccgacgaagctttattatgtcggaccgatgttccgttacgaacgtccgcagacagggcgtttccgccaattttatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcggagaattttgctcagactgccagtcgcgtctgcacacaaacccgctcagaattcttgactgcaagaaagacagagagcatgaactgatgaaaacggctccgtccattcttgattacttaaatgaagaatcagccgcttattttgagaaagtaaaacaatacttaaacggtctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgactgctggcagccattgacgctgagaaaacagaccttcccgtcaatcaggggatcgactgctacatcgtgacgctcggagaaaaagcgaaggattattccgtttccctcgtgtacaaactgagagaagcgggcatctcaagtgaaatcgattatgaaaataaaaagatgaagggccaattcaaaacggctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgtgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgacgtttctgaagacgtccggttaaaacaccgctatttggatttgcgccgcccggcgatgtttcaaacattgcaaatgcggcatcaagtcacaaaatccatccgccatttcttggatgaaaacggatttcttgatattgaaacaccgattttaacaaaaagttctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatattgaaatgtcctttatgagtcaagaggacatcatggctctggcggaagagatgatggcgaaagtcatgctcgaaacaaaaggcgttgaagtatcgcttccgcttccgcgaatgacatatgaagaagcgatgaacagctacggttccgacaaacccgatacccgcttcggcatgctgctgacggacgtgtcagacatagtgagagatactgaatttaaggtgttctcatcagccgtggcaaacggcggcgttgtaaaagcgatcaatgtcaaaggcgctgccggcgactattccagaaaagatatcgatgcgctcggcgtttttgccggaaattacggcgcgaaaggtctcgcttgggtgaaagtagaagctgacggcgtaaaaggcccgattgcgaaattctttgatgaagagaagcaggcaaaactggctgaagcgcttgatgcttctgaaggcgatctgctcctgttcggcgctgataagtttgaggttgtggctcaatccctcggcgcgcttcgcttaaagctcggcaaagaacgcggcctgattgacgaaagcctcttcaacttcctgtgggttgtggactggccgttattggagcatgacgaggaagaaggccgtttctatgcggctcaccatccgtttacaatgcctgtccgtgaagatcttgacctgattgaaacggcgcctgaagatatgaaagcgcaggcttacgacctcgtcttaaacggctatgaactcggcggaggctcaatccgtatttttgaaaaagacgttcaggaaaaaatgttcgggcttctcggctttacaaaagaagaagcggaggaggagttcggataccttcttgaagcctttgaatacggcgctcctccgcatggcggaatcgcgctcggcttagaccggttggttatgcttcttgcaggccgcactaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcggcagtttgtttcttgaaaatcaaaatctgctgtgatatgattttgacaagttaaataaagtcctgatgtgttagttgtacacctagttttgaccgaacatttttttgatttgggagcccgcatttttaaatggcgtacatgcctcttttcattcgctaaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgacattacaaacgtaaaccgccagctgcatgcgctattgtcgacggtgggacagccgaaaacagaattgatgaaagagcggatcgctgatattaatccggattgtgacgtcgtcgccttaaaaatgttttatacagaagagacgtatgagcagttctttgagtatccgctcgattacgtcattgacgcgtcggatacgattcattataaaattcatctgatgaaagaatgtctgaaacggaatgttccgctgatttcaagcatgggagcagcgaataaaacagacccgacacgctttcagattgctgatatttcaaaaacccatactgatccgattgccaaagtcgtccgcacaaggcttcgtaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgtcatggagctcttaaaggacatcgacattaaacgggttaaagataagtaaaaagaaaaacagccttcttcaggaaaggctgtttttttatttgaatccgccgtttacacgaaagatcttgtccggttattttttctgcttcatcagtttttcatacacttgctttatggcggcttcaaatttccccgtttgtttcggtttatagtattgcttgttttttaacggatcgggcaaatattgctgttcgacccatccgttctcgaaatcgtggggatattgatagccgatcccgcgtccgagctcttgggcccctttatagtgggcgtcttttaaatgtttcggcacatcgccgattttacccgtcctgatgtctttgagcgcctcatcaacggctgaaatggcggagtttgatttcggtgagaggcataattcgattaccgcattggccagcggaattctcgcttccggaaagccgatccgttctgcggtctgaatcgcgctcagcacccggggcctgcctgcgggcttgcgaggccgatatcttcataggcgatcacgagaagccttcttgatatgctttcaaggtctccggcttcgatcagacgggccagataatgaagggcggcgtttgcgtccgagccccggatcgatttttggaacgcggataagacgtcataatgcgcatcgccgtttttatcatgggtatagctttttttctgcagacattcttccgccgtttcccgtgtaatccggatcgtcccgtcgcttgattcctttgtggagagcacggcaagctccagtgcgttcaaagcggagcggacgtctcctccgcacccttgtgcgaaatgatccatcgcgtcgtcgtccaccgaaacgctgtaggaaccgagtccccggtgttcatctgtgagcgctcttttcaatgcctgcctgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagtctgtgcacttcatcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgcttcgcacgcaccattctgccgatgattttatcttctttgaccaaatgttcctgaccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctcagaaacgccggactcgtaaaaagcatcagaggcgcttacgggggttacgtgctcgggggccagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtaaagacaatggaacggatttatttagatcatgctgcgacttcccccatggatgaacgtgtgctcgaagaaatgaagccccatttcttcggcagtttcggcaacccgtcaagcattcattcattcgggagagaatcccggaaatgggtcgatgaagcgagagcggacatcgcgcgcgaaatcagtgcgaaagaacaggaaattattttcacaagcggcggtacggaggctgataatttagccattttcggaacggctgccgcccggaagaatgaaggaaagcatatcattacgaccgctgttgagcatcatgctgtattgcacgcctgcgaaaagctggaagaagacggctttgaggtgacatacctcatgcccggcccttcaggacggatcagtgcaaatcaggtgaaagaagcgctccgtgatgatacaatccttgttaccgtcatgtatggcaataacgaagtcggaaccattcagccgattgacgaaatcggagagctgttaagcgggcatcaggcctattttcacacagatgccgtccaggcattcggttatatgccgattgatgtgaaaaaaagcagaattgacatgctgtctgtttccggtcacaagcttaacgggcctaaagggacaggctttttatatgtaaatcaagaggtgaagctgtcaccgattcttcttgggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacatcatcatgagcacgctggaagaagccggcgttacagcggaggtgaacggagatgccgagaaatgcctgcctcatattttaaacctttactttcccggtgtgccggtggaagcgctgctggtcaatcttgacatggaaggcattgccgtctccagcggatctgcttgtacggcgggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttatgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcagatacagtgcgcatgctccgcggtctggatgaaaacaaggaccagacttattttctgaatcagctcaatcaggaacagctcagtaaagtcatgttcccgatcggtgatctgcaaaaaagccgcgtgcgggaaattgccaaagaagcagaacttgcgacagctgcgaaaaaagacagcacgggaatctgctttatcggcgaacgcaacttcaaaacgtttctcagccaatatctccccgctcagccgggcgatatgatgacaatggacggagaaataaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattccgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaaatcatttttgacgggcaggtacgcgccgttacgccgggacaagccgtcgttttttatgacggagaagagtgcctcggcggcggaacgatagatgacgtttataaagacggaacaaaactgtggtacgtataacacatgtaaaaaacctcaactcgcatgttggggttttttagcgaaaggaagttaaaaatggattataataaaatcgggattgacgccatgcaggagggcgattttgaaaaagcggcagaggcttttacgaaagcgattgaggaaaacggccaagacccggtgccgtacatcaacttcgcaaatctgctttcttctgtgaacgaactcgaacgggcgcttgcattctataacagagcgcttgaattggacaattcggcggcagccgcttattacggtgcgggaaacgtatatgtgatgaaagaatcgttttccgaagcgaaggatatgtttgaaaaagcgcttcgctccggaatggaaaacggagatttgttttatatgctggggaccgttctcgttaaattagagcggccgaagcttgcactgccgtatctgcagcgtgccgttgaattaaacgaaaatgacacggaagcgcgcttccagttcggaatgtgtcttgcaaatgaagaaatgctggatgaagctcttgcgcagtttgagacggtgatcgagcaggatccaggccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcataatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaactgccacgcatcctaagttcggcctgcaatttcaggctgaacactttaaaaaagaaattccgaccacaaaagaaggaatcattcactatttatcaagtgatctgtttgaaggaatcggaaaaaaaacggcggaagaaatcgtcaaaaagcttggagacggcgcgctcaataaaattctggctgatgcgtcggtgctttatgatgtgccgaaaatgtcaaaaaagaaagcggacaaactggcgggagagctgcagcggcatcaggggcttgaacagattatgatctctctgaaccaatacggtttcgggccccagctatccatgaaaatatatcaggcctacgaaacggaaaccttggagaaaattcaggaaaatccttatcagcttgtaaaagacgttgaaggcatcggctttgtgaaagctgacgagctgggcggaaaaatgggtctgtcaggaaaccacccggagcggatcaaagcggcaatcttatatacgattgaatcgacctgtctttcagagggccatacgtacatagagacaaagcagctgattatcaatacgcaaacgctcctgaatcagtcagctgaaggcggccgcgtcacggaaatggatgcggctgacggcatcatcgccctcggggagagtaaggatatcgtcatcgaaggagagcgctgctattttccctccttgttttacgcggaacaaaacgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccgggggacctggaacggggaaaacgaccgttattaaaggaatcgtggaattatacagtgaactgcacggcgtatcccttgaccccggtgattataaaaaagacgaggcgtttccggtgctgcttgccgcgccgaccggaagagccgcaaaacggatgagcgaatctacgggtctgccggctgttacgattcacaggctgctcggctggaatggcgctgaaggctttacctacaacgaagatcagccgattgaagggaaactgatcattatagacgaagcgagtatgcttgatatctggctcgccagccatttgtttaaggcgcttcctaagcacattcagctcattgttgtcggtgatgaagaccagcttccttcagtaggaccggggcaggtgctcagagatcttttggcttctgaagtgctgccgaccgtgcgcctgacagatatttaccgtcaggctgaaggatcatccattgtggaacttgcccatgatatgaaaaaaggactgcttccaaaggggctgaccgcgccgacaaaggaccgctcatttatccgctgtaattcttcacagattaaagaagtcgtggatcaggtcgtctcgaatgcgttaaaaaaggggtatacctccagagatattcaagtgcttgccccgatgtacaggggaaaagcgggaattaacgagctgaatatgcttcttcaggacatcatgaatccgcctaaagaaaaaaggcgggagctgaaattcggagatgtcgtctacaggacgggcgataaaatattgcagcttgtcaaccagccggaaaacaatgtgtttaacggcgatatcggcgaaatcgtgtccattttttatgccaaagaaaatacggaaaaagaagacatggtcgtcgtctcgtttgacggcaacgaaatcacctttacgaaaaaggatttcagccagtttacccacgcttactgctgttccattcataagtcgcaggggagcgaattcccgattgtcgtcctgcctgtcgtcaaaggctactatcgaatgctcaggagaaatctgctttataccgccattacaagagcgaaaaaatttctgattctttgcggagaagaagaagcgcttgaatggggcgtcaaaaacaatgatgccaccgtcagacagacgtcgcttaaaaacaggctcacagagcagactgaagagatggatgcagaactggccgccctgcaaaaagagctgccgttcagtgtatatgatgcgaacatcggaatggaaggcatcacgccttttgactttatggaagaaaaagcgtaaataaaacccggcacatgttcatgcgccgggttttcgcctgtggaagtcatttcaaagtatgctgcctggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcacaaccgtcatctttttttaggggcaagtgatataaaagagatggatcaagaagccgtagctgccggtcatgctcatttgcagcctttgccgaagagctgtttcacctttgaacagattaaaatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatatgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtggccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggggctggagccgttatgtatcgtatggcttctcagtccgatatgctgaataaaaaaggtatgaaacggatgagaagacgagtcatgaaaatgttttaagcggaaaaaaggatacttctccggaagtatcctttttacgtttgtctcgcttccagccgtctggcagcgagagacaggctgtaattgaccgcgaaatacatcagggccgccagcagaaagatcgggaaaaaataccccccgtcagcgctttgtccgtttaaaatctgcgcgttatgaatcagttcgggcagagcgatgacgaccgcaagtgacgtatcctttaataaggagataaactggctcacaatcggaggaaccatacgcctgagcgcctgcggcatgacgacgagaaaaagagtctgcgtgtacgtcagtcctgaagaacgcgccgcttcaatctgtcctttgtcaacggattgcaaaccgcttctgatgatttctgacagcatggccgattcaaaaatcgtcagcgccgtgatggcggccgcggtaatttccagtttgatcccgatttccggaagggcaaaaaacgtaaagaaaatgattaataacagcggcaggttgcggatggtttccacaatggccgctataatgcccgagacgataggaatgttcgcatagcgcaaagtgccggcggcaagcccgaacataaaactcaggacaatggagatcagcgcaacataaagtgtgaccaaaaagccgtcccataaaaacagcagatggtcaggtgtataggcgccgctaaaatccatgttattcactctccttctctaataactttttccgagacgtctttccaaatagtgaaccccgatgctgagcgggatcgttaatatcaaataaaaaagcgcgacgaaaatatagacatcaaacacgacaagagtgctcgaggacacgagatccgcctgatacatcaaatcgagtcccgccaccactccgagtattgatgagtttttgacaaggttgagaaattggtttccgagcgggggaatgacgatttttacggcctgaggaagaatgatatatctcatcgcctgactgtaggtgaagcctgacgatctggccgcttccatctgccctttggggacagtctgaattccggctctgatggcttctgcgataaaggcggacgtgtaaatcgtaagcgcaatcgttcccgcctgaaagccgtccagtctcagcccggcgttcggaagtccgaaataaaaaacgaatgtgatgaggagaagcgggatgttacggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcatgctcatcccgcggtccgtcctattttgccggttcttcttttatccattttttatagattttttcgtacctgccgtcggctttcatttttttcaaagaggcgttgatttctttgacaaggccggattggcctttttgacggcgattccgtaaggttcatcggtaaaggtttcgcccgtcagctgatattgtttattttcatcggccatgccgtataaaatcgcattatcggttgtgagcgcatctccctgtcccgctttaagcgcagtgaacgcttcggcgtaattttcaaattccagcactgaggcgtcaggcgctttttctctgatgttctgtgaggaagtggagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatggcgtcgatatcgccgttttgcagcatcggaatcctcgtttttgacgtcacttctttaaattccgctttcttctcatcccccagaatatcttttgcgagctgttttgagatatcaatatcgaagccttcaatatcaccggagcttgggtttttcagcccgaataacctcgtatcggttttgacgccgaagatgattttgtctctgtctttaatagaggctaacgtgtcttttcccgttccttttgaatccccggacgtttctttccctccgcaggctgccagcataaagacggccagcagtgatatcaatccgaatgacaaccattttgttgcgcgtgacataagcgctcctccgtttcttttcagtgatttaaaatacggcttaagaataaacgcgccctctcttcacgggggctttcgtaaaattcagccggtgcagcttcttctaagatggatccgccgtcgataaacacgatgcggtccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagcccctggcgatggcgacacgctgctgctggccgccggaaagctgtgaaggataagcgtccgctttgtccggtataccgacttttttcaaatagtataaggccgtttcctttgcttcttcttttgattgcttgagcactttgatcggtgcgagcatgatgttttgcagaacggttttgtgcgggtacagatgaaaatgctgaaacaccatgccgatattccggcggacctgatttatatccgttttcttgtcacggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagttttgaaatcctttaacacattacgatggttatacagacttttatgaatattatttagattatttcgtaatttctgataattatttccgtcaagaggtctgcgtcataaggcgtagtttatgaaacgggaataattccggctttctgtcaaaagataaagcaagaggtgaaacgtcatgcttcaaaaaccgctgcagctcttaatgtggacagctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctgcttctgatttattgcctgtttttcggcggaatcggctggggggtttataaaggggttcctgttttaattgaacagctgcaggatctgtctgagagcattcccggtcttgccgaaaactacaacagcatgctgaggcatctgcataatcacacggatcattggcctgacggcatgcaccatcggatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatataggcgtcatgaaaaagacggtctggtatttgacgccgaagtcctggagaaaaagggggagtgaatttctgcgggatgtggacgactctctcggtgattacatccgcggtcagcttctcgtttgttttttgctcgggttaatagccggcgtttcattttggctcttcgggcttccttacccgctgattttgggccttgccatcgggattacgaatgtcatcccgtatttcggcccgtttatcggcgctgtgccggcgctgctcctttcgctggcgatttcctccaaggctgtgatcatcgtaatcgtcacgatttttattcttcaatttatagaaggaaacattttgagcccgctcattgtcgggcgaagtctcagaatgcaccccgtcgtgatcatgcttgcgcttcttgccggaggagagctcgcgggcattcccggcatgattctcgctgttccggcggcagccgttttaaaagtgacggccattcactttttgcggatcaggacggaacattgacattcgggttctgcttgtctataatttcgagtagaatacatacgaatctcgagtgacggataagagtacgccgaagccctgtttaagagagaagctccgatacgctgagaggagcttcagcagaagatcggccgaagctaatcctgagtgcagttaaaggctgccgcaatcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtacgtcaaatgtttttagatttctttaaagaaaaaggtcatgccgttgaaccgagcgcctcattggttccgcatgaagatccgtctttactgtggatcaacagcggcgttgcgacgctgaaaaagtactttgacggccgcgttgtgccggagaatccgagaattgtaaacgcgcaaaaatcaatccgcacaaatgatattgaaaatgtggggaaaacggcgcgccaccacacgttctttgagatgctcggaaacttttccatcggtgattattttaaagaagaagccatcacgtgggcatgggagtttttaacgagcgaaaagtggatcggctttgatccggagctgctgtctgtaacggttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggtaatgacccgtcagattctgaattgtatccgggcggcgaaaatgaccgctatcttgaagtatggaacctggtattctcagagttcaaccacaacccggacggcacgtacacaccgcttccgaagaaaaacattgatacgggcatggggcttgaacggatggtctccgtgattcaggatgtcccgacaaactttgacactgatttgtttatgccgattattgaagcaacagagcgcatttccggagatgcttacggaaaggacgcaatgaaggatacggcctttaaagtgatcgccgatcatatcagaacggtcgcatttgcggtaagcgacggagctctgccgtcaaatgaagggcgcgggtatgtactgagacgcctcttgcgcagggcagtgcgatacgcgaaaaccatcggtatcagccgtccgtttatgtacgagctggtaccgactgttgcaggaattatggacgctttctatccggaggtgaaagaaaagcaagagtttatcgccaaagtcatcaaaacggaggaagagcgcttccacgaaacattaaacgaaggtctggccattttatctgacgtgataaagaaagagaaggaaaaaggcagcggcatcatctccggaaaagacgtattcaaactgtacgatacgtacggattcccggttgaattgacggaggaatacgcggaagatgagcaaatgaaggttgaccataaaggctttgaagccgaaatggaaaaacagcgtgaacgggcgagaaatgcgcgccaagatgtaggaagcatgcaggtgcagggcggcgcattgcgcgacattaccgcagaaagcacatttgtcggctacagtgccgtaaaagctgaagcgaaggtgatcgagcttcttcatgacgggcaattaatcagcgaggcgcatgaaggggataccgtccaaattcttcttgacaaaacgcctttctatgctgaaagcggcggacagatcggtgacagaggagtgctgagaagcgagcaggctgtcgtaaccattaaagacgtgaaaaaagctccgaacggccagcatgtacacgaaggcacggtggatagcggcacgattcaaaaaggcgcaagcgtgacggctgaagttgaagatcaaatgagaagcggtgtggtgaaaaaccatacagcaacccaccttctgcaccaggcgctgaaagacgttctcggcacacatgtcaaccaagcgggttcactcgttaccgaaaatcgtctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatatcgtccgcgtcgtacaagtcggagattacagccttgagctttgcggcggatgccatgtcacgaatacggctgaaatcggtctgtttaaaatcgtatccgaatcagggatcggcgcaggtacgcgaagaatcgaagccgtaacaggaaaaggcgcttatcaggaaatgaacagccagctcagccttctgcagcacgctgcggatgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtcaaaagtaaaagacatcggcggcgtaaaagtgctggctgaaaaagtaaatgcgaaagacatgaaccaccttcgtactatggtggatgatctgaaagcgaagctcggttctgcggtcatcattctcggcgccgtgcaaaacgagaaagtcaacctttcagcaggcgtgacgaaagacctgattgaaaaaggccttcacgccggcaaaatggtcaaacaagcggctgaagtctgcggaggcggaggcggaggccgtccggacatggcgcaggccggcggaaagcagcctgaaaaattggaagaggcgctcgcatctgcggaagattggataaaatccgttttataatcctttcaactagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgattacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcagggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaagaaatggaacacggcgaaaaacatattacaattgtcgatgatcaaggcaacgaacagctttgcgaagtgctgttcacatttgaaaacgacacattcaacaaatcttacgtactttattatccgattgatgctcaagacgatgatgaaattgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaaaattcatttccgcgtaaaaacaaaaaaacaacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcaaaactggatgacaaaacattcatcggcaaactgaaaaaacagtttcctgatacaataacggacgcactttcaaacaagaagctcaagcatccgctcgaaggctatctgtatccggccacatatccgtttaatgatccggatgcatcgcttgacacgattttgacggcaatggttcaggaaacaaatacccgtatcgaaacgtataaatctgaactggaaaaaaagaaactttccgtccataacgcgctgacgatggcatcgcttattgaagaagaagccaccgccaaagccgaccgtcacaaaatcgccagcgttttttacaacaggcttgcagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaaccaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagcctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccgggttcacgtaatgcacggggatgcgctggaactttctgagtctgtccgtgtcacggctccttatgatgccatttttatcgacgcggccaaaggccagtacacgaacttttttgagctctatgaaccgatgcttgcgccggatggagtcatttttacagacaatgttctgtttaaaggactggtggcacaaaatcactcggacattgagccgaaaagaagacggaagcttgttgaaaaaattgatcaatataaccaatggctgatgaaccggcctgactatcaaacggtcatactgccggtcggagacggcatcgccatcagtaaaaagaagaggtgaatgatcatgaaaaaacctgaacttttggtgactccgacttctgtacaggatattcttccgctcattcaagcgggcgcaacggccctgttagtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgatccggccgttttaatggcggcgcgtgaagcggctcccgatcttaaactgcactggagcacggaaacaacgggtaccaactactattcctgcaattactggggacgcaaaggcgcacggcgggcagtgctggctaaggaattaaatatggacagcatcattgacataaaagaaaacgccgaagttgaaattgaaattcaaatccacggcatgacgtgcatgttccaatcaaagcgttctttagtgggccattacttcgaataccagggaaaagtcatggacatcgaacagaagaaaaaagaagcgggaatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatctgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaattgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggacattgaaatcgaaacctttatccacggcgccatgtgtatcgcttattcaggacgatgcgtgctgagcaatcacatgacagcccgggattccaaccgcggcggctgctgtcagtcctgccgctgggattatgacctgtatcagacagacggtgcaaacgcggtcgcgctttatgacgaagaagacgctccgtttgcgatgagcccgaaagatttaaaattgattgaatccattccgcaaatgattgagatgggtatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtatgacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttagatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcattattctggaaggcattctcgttctcgaagataaaagacttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcggacaaaaccacgtcgcaattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgtaaagaagtagtagagcgcattaaaatcgcaagaagcttcggagatctgtcagagaactctgagtatgattccgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgcccgacggtgaagaagaatcttacacgattgtcggaagcgctgaagctgatccgtttgaaggaaaaatctcaaacgactcgccaatcgcaaaaagcctgctcggcagaaaagtggacgaagaagtgacagttcagacgccgggcggagaaatgctcgtgaaaattgtgaaaatttcataagatccgtttaacaatgaaacacctcgtccaaaatgtggatgaggtgttttttatgatcgtatcaaaaaggctgaaaacggccgtgatttgttttctgctcgtgtttttctttctgcttgcaaggctggctgaaattcagctgttttttacagaatctttttcaaaatccaatattaatctgattcaggaaagcgtcaagcagcggacggaagaagtccttatttcagacggccgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctgacggaagcaaaaaaaccggtgatcctgaacagcagaaaaataaaacatttgacgaaacaatccgtggcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaaaatcgggacaagcgggatggagcggacatttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtgtttaaaacggtgatcgccgcagccgcaatagaacaaaacgaagtgaagccgggcacatcctttaactgcaatctcaacctgtacggagagccgggggatgataaaggcacgctcagttttggagaaagctttgcccaaagctgcaattatacgtttacaagtcttgcggaaaaattaatcaaaaaagatgattccgttattgaaaacatggcggagaaactaggtctcacacagcgggcgggctgggaaggcaagctgtaccgggaagacggattcagacagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgagaaaaaacaagtcaaaatcgcggacaaaattgaatacaaaaacaaaacgacgatggcgtcattcaaagaacagccgttaaaaggggaaaacatcgacaaatatacggcgcagcagcttcaaaaaattctcagagaagtcgtcacctcaccgaaaggaaccggccgaaggtttcaggatctgccgtatgagatagcaggcaaatcgggaactgcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaacaaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgcagtcagcctcttcatcaacagtccgtcgagcgacgtgagcgaaaaagcggacacgagccagaagcaggaaacacctgcatcaggcaagacgaagcagacatccgatgaagacataaaagacagcaaaaaagatacggcatcagacgatgacaaaaaagataaacaggataaggacacatctgattcatcttcagactctgacagcaaaaaagacgatgattcatcgaaaagtgatgacagcagcaaaaaagactctgattcaagcgatccttttaaaggcgcaaaaataacagagggcggctcatcaagcgatgttgagaaaacaattgttaacccaaaatggaaagcggtcggaacaaagcagacgggagaacatgcggcgacgtatgactcaagctctgaagactggtccgaaatgcttgacgccatctcttacgcaacaggcgtgtcaaaagatcacatgacagtgctgtggctcggaaacaatggaagcccgcaagatgcgaagggtaaagttttagacaaaacgaacggcaaaaagtatcaggtcaccatcacttggaaagacaaaaaaggctggaagccgacaaaagtagaaacgttaaaataaccgcaaaaaagcagctgattattcagctgcttttttctgtcatacgtcagctgaaaaatgcaccgacgcgctgtaaaggattctgccgtcaacggccgtcacctgatgggatacagaacggacgcgaagcataatcgcctggttgttttcaatctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattccattatttgaagattgggcagcgacttatgatgccacagtgcacggggcagacaaacaatacgctgatgtttttaaagggtatgacaatattcttgacagcatcgtcgcactttcgggttctaacgttttagagttcggaccgggcacagggaatttaacggcgaaattagccgccgcgaacaaaaaggtgtttggtgtagaaccgtctccgtcaatgagaaaactggcggctgacaagctttctgacaaagccgtgttcagtgacggagattttctggagtttcccgctccgccttttcaaatagataccatcgtcagctcgtacgcctttcatcatttaaccgatgaagaaaagcaagcggctgtaaagcaatatggcacaatccttcagaagcatgataaaatagtgtttgccgataccgtctttaaagatcatgaagcttatgatgaaacaattaaaaaagcaatccgaaacggctatcatcaattagcggacgatttaaagacggaacattatccgacactcgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacgacgggcagctatgaaggcgtcgaagttatcttgctgaaatcggggatcggaaaagtcaacgccgcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtggatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccaccagttcaaaacgccttttgttgtcatcagagctttatctgatattgccggaaaagaatctgacgtttcatttgataaatttttagaacaggctgccgttcattcaactgagcttgtcctgaatgtcatcaaacgaattcactaagcgggggattctcgttctcctccgcttttccaggaggaggacatatattgaacgtgataacagatattacagaactgatcggaaatacaccgctgctccgtctcaagcattttgatataccggagggaacagcggtttatgctaaacttgagatgatgaatccgggcggaagcattaaagacaggctgggcggaatgctcattgaagatgcgctacgcacgggaaaggtgaaaccgggcggtgttatcatcgaagcgactgccggaaacaccgggatcggactcgctctgtgcgccagaaagcatcagcttcgcgccgttttttgcgtcccggagcatttcagcagagaaaagcagcaaattatgaaagctctcggagcggacatcgtgcatacgccgagagaagaaggtatgcagggagccattcgaaaagcgcttgaactggagagagagattaataattcttatgccgttctgcaatttaaaaaccgagtaaatccattgacttactataaaacgatcggacctgaaatatggaacgcgctcggcggggatatccacacctttgtcgcaggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatccctgattatatggacgagaaccattttgacgccatttacacagtggaagacgatacggcgttttcgcttgtcagagaagcggccgagaaagaaggcctcttaatcggaagctcttcaggggcggctctttatgcagcgcttgaagaagcgaaaaaagcgcccgccggatcaaatatcgtcactattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcatacgggttatgaatattcaagaacggccaatccgacgcggacggcgcttgaaagcttaattgcggagcttgaaggcggcgcggcgggatatgcgttcggctcaggcatggctgcgattactgccgtcatgatgctgtttgacagcggcgatcatgttattttgacggatgatgtatacggcggcacttaccgggtgatgacaggtgtgctgaaccgcttcggtattgaagcggactttgttgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacattttacacgccgtatttccagcagccgctcagctttggcgcggacatcgtgctgcacagcgcgacaaaatatctcggcggccacagcgatgtcgtcggcggcttagttgtgacggctgataaagagctcggtgaaaagcttcattacgtgcaaaactcaacgggcggcgttttaggaccgcaggattcatggcttttaatgagaggcattaaaacactgggactcagaatggatgccatcaatcacagcgccgggaaaatcgccgagctgcttgaagcgcatgatgccgttcagacgctctactatccgggatcagcgaaacatccgggccatgagctgacaaaagcgcaaagctccggtttcggcggaatgatttcctttgatatcggcagcagtgaacgcgtcgacgcgtttttagaaaaattgaacctgtttacaatcgctgaaagcttaggagcggttgaaagcttaatctccgtgccgtccagaatgacgcacgcttcgattccgcgcgaccgccggcttgcgcttggcattaccgacgggcttgtacggatctcagtcggtattgaggatactgaggatttaacggcggatgtgaaacaggcgcttgattcccttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatatcggcgcggttcttcccggacaagggctgactgcgggccagaaaatgctgatgtttgtaacggattgtgcatttttagcgggcgcttatttctgcgttgaccgttcacttatttataaaaagaggctggaagaggccgaagaataaaaaaagccattgtcttttgacaatggctttttcatttcttattcagaaggggtttcgcgtaattcttttcccattccttttaaaaactgcagcccgaagccgagcgcgcggttaatatcaggatcaccgacggctttcatcagttcaaacatactgactttcctgtcctcttttaaaaatctttgcgcctggtccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagccattcagctctgccataatggacatcgttttcgcgacggcttcttcattttctgcgagaagcgtcttcagttcttccagtttttcagctttcagctgttcctctgttttcgtttctttttgaatttcagtaattgggcttgccattatgtttcctcctttccttaatcagttaggtgcacatagcccggacggttccattttcgctgagcttccacaccgttttgcggatgacgttttttgttccgcggattcgttttcggaagcggcggtgtatcacaggaaccgagcacttccatgcggacttttgtctgtttataggcaggtgtatgtgtccgtgaatcatacgcaggcccggtcaggaaattaatcgcagaatctttatctgtagagttcatcggcagataaagctcatttgcgcggacacggtctgtcacaagcgcattcaatttaaccgccccaaaaggagagacgagccggatcattgttccgtcgcaaattccgcgttcagccgcgagctccggcgatacttcaacaaatacatccggaactttagactgaatgccttttgacttgtttgtcatgtttccttcgtggaaatgttcaagcatccgtccgttgttaatatgcaggtcatattcttcagggaatacggcaggctccacccaatcgctcagcgcaaaacgggcttttttgtccgggaagttaaagccgtcttcataaagaagcggagtgctctctcccgtaaagcttccccacaggaagctgttccagccgctaagaacgtcgtagcttgcttttccgaacagcggagaaaggctcgccatttctgagaaaatgtcgcttggatgcgtgtaattccaatcagcgcctaaacgattggcaacctcctgaataatccaccagtcgggtttggcatcgccgagtgtcggaagcgcctgatacaatctttgtacacgacgctctgtgtttgtaaatgttccgtctttttcaagagatggaaccgcaggcaggatgacatccgcgtattgcgccgttcttgaaaggaaaatatcctgtacaacaaagaaatcaaggctggataaaatgtcatgaacatggttggcgtttgaatcgacgagcgccatatcttcaccgacgagatacatggctttcatgtttccttcttcaatcgcatggagcatttcaatattatcaagacccggcttgccgtcaatttcaacaccgtaagctttttcgaatttagcgcgtgccgcatcatcggtaatatgctgataccccggaagccagcctggaagagttcccatatcgcaagcgccttgaacgttgttatgtccccgcagcggataagctccggcgcccggacggcggtagtttcctgtggcaagcagcaggttggaaatcgccgctgatgtatcagagccgcctgtattctgggtaacgcccatgccccaaagaacacaagtgccgtctgcatcacgaatcatttcggcaatgcggatgatcgtatcctgagaaagtccggtgatgcgctccgcatattctaatgtatactttttcagcgtttctttataatcttcaaagtagttgacattctcatcaataaacgcttgatcgtgccagccttggtcaatcatatattttgtcactgccatgagccagacttggtcagtcccttgtttcgggctgataaagaggtcggaccgttcagccatttcatttctgcgcagatcggcaacaattaatttttgtccgtgcagcttatgtgcacgtttcacgcgtgtggccagaaccggatgtccttctgccggattggcgccgacgatgagcacgaggcccgcttttgcgatatctttaattgtgccggcgtcaccgcccataccgactgtgcggaataagccgtccgttgccggtgactggcagtagcgtgaacagttatccacgttgttggtttcaaatacttgacgcgctaatttttgaataacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaatccgttcttccgaatttacgaagtcccagccgaatttccctttcacacaagtggaaatcgcattaaccggagcatcggaaacaggctgaattttaaggatgtcacggccttttgtccatacttcaaaagagcatccgacgccgcagaacgtgcagactgtttttgtttttttcgtccgtttatcgcgcatagccgcttccacttctgacacggcgaagatgcttgtatagtcgggttcaacatttttcactaaatcaatcatcggttccatgacatcttcttttattcctgtcataaatccggcttggccgagcattgatttttccatcagtgcgttacaagggcagacagtgacacattggccgcagctgacgcaggatgattcattaatggggacgccttcatcccaaatgacccgcgggcggtcgcgctcccaatcaattgaaagggtctcattcacctgaaggttttgacacacttccacacattggccgcaggcaatgcattggttcggatcatagcggtaaaacgggtgagacatatcaaccgcgcactttgaatcatctttcggcgtatacggatatttctgatgctcaattcccatcatttccgctgtattatgcagtgtgcagttgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgctgcaatttcccgtttacttcaacaatacaggtgtcacatgtttgaatcggatctacttccggtacatggcatatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaaagccatgcacatagataccggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaggtgaaatgtcacaaaggggaaccgggaatgtctttcataggctaaaatcggaggggacaatatgtctaaaaaaattcatgaatttaacgatattatccggaaattgcgcaaagaattatttggaaaggggccggaacgaattcacaccgtttttgtggataacatggcggtatcaacgctttacggcaatctaagcgcaagtgagcagtttatcgcacgcacgcctgaaggaagagaaatggttcatgcggcgcggaccagcttaattcaggaactgtattcaaaacaaacgcctgacggaatggaagagctcatcggagcaaagctcgtgcatctgttttcagacatcaagatcgaagagaatattgcggtgtctgtatttgtctttgaccgaacaattgaagagcgccgtgaagaaatcaaaagctgaaaaaaattcaattgacacgaaattgtcacatttgatatgatatgaactgcctgcagtggcttaaggacgaattttatggaatgtgtgcatgatctgtacattttctatagctgatattttcattctgcttgatattgttgtatgggtatgcatacaagttaggcagcattcaaacccgttttagacgggctgtttgaatgctgccttttttgttaggcgtctttggaaactgcggggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcttgtcgagtttaatcggggcgtccgtgtttcccatcggattggtgctcgtcgttcttgccggcgcggagctgattacgggtaatatgatgtcggtatctatggcgcttttttccagaagaatatccgccggtgcattagtgaaaaattgggtgatcgtgacgttgatgaatcttgtcggcgcactgtttgtcgcttactttttcggacatgttgtcggattaaccgaaacaggaccttacttggaaaaaacgattgcggtcgcacaaggcaaattggatatgccgtttggaaaagttattgtttcggcgatcggctgtaactggcttgtctgtttggccgtctggctttctttcggcgcagaagacggagccggaaaaatcgcgggtatatggtttccgattatggcgtttgtcgcgattggttttcagcacgttgtagccaatatgtttatcatcccggctgcgatttttgcaggttctttttcgtggggtgatctgattggcaatctcattccggcctttatcgggaatgtaatcggcggggcagtgtttgtcggccttatttattttattgcatattcaaaaaaagatcagaaaaagcaagggatgaaaagagtttcctgaggtaagaaagatgccggaaaacaaggacaattgaagcggaatgccagcacattttccgtccaaatcttgaaaaaaatgtttacaaaatggaagctgatggatatacttacaaagtaagaaaaaagcaaagggaggttgaatcacatgacgactttaaacggcaatcaaaatttacaattgaaccgattcagcctgtggaagagttcgtgtccttccttaacctctgcccgtcaagcacgttaatttcggagtatcaggacattcgcagctccccgcagggaaagaagcacgtcttcttttgtctgcggatttagtctgcccgcagcgcatatgaagtttgctgcgggttattttcgcttgtgcggatattgaaagggggtgagcgataatgaccattaatcttttctttttaacactgaccatttcaaagcgttttaaaagtgcggaagagtatgaacgagaacagcaggtcgaagagttttataatgaagcgaaagaacgccagctgaaacacttttatatgaactgaacggacacgaagggccaaaacggaggagaaggaggagatcatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacagaattccatccatcgggcacgggtatgcgtcaatgccccattcatttaaacacggctacggcaacccgtatcgccggcagagaatggcggcgctttcccggcagacaagatatatagcaccgtattattggtactagagcaggcggaaaacctacgttttccgtcttttttttatgaaaacaaatataaatttcaaataaatcgaaacgttcatgaagagaagtgcgtctagttagtacctcatactaatacgaggtaatattatttctgaataataaatcacaggaatggaaaagcgggtgttatacaatgttgcaacatacatcttcagcattaaaacgaatgcgcgcgaaatactttgctgcatcagaactggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggcgcggaaacattcagcaggggaggcctgaaagcttaccgttccgcgatcgcagctttcataaagttttctcattacatactgctgaaacagtcagcgattacaggacagcatgtaaagaagtgtaccgcgttcttcaaattgacgggtgtttctatatggttttgaaaccttcgcggatgagtgagaaggatgtgattgaggtgctctatgatcagcatttcagagacatttcagttgtcagcagagattcattccattttattactgccattaaatagaatatttcttgggaaataaaaagagctgcttaagtcactgcagctctttttgtgaaattgggcatatttccttatttttggttatttcacatctattttatattaaaaaaagtttttttcttatacaatggtaatcagatgaccgtacattttaaatgttttgaacaaacggaatgaatattcattccgcatctggaaagggggatgaaatgacagcttcaaacaaggttgaactcattatgaaagcgtcgcttactttgtttacagatagaggatttgacgcaacgacgattccgatgattgccgctcaggccgatgtcggaaccggcacaatctaccgttactttgacagtaaagagacacttgtgaacgtactgtatcaggaaagtgcgcagcgttttatgaaaaaagtcaaaacggactttcagggtatctctgtaagagaagggtttcatcacctgttttattgtctgattgattttacgaaggaaagtgagtatgcattgttttttcttgaaacgaataaggacgcctactttctgaatgaaacgagccgtaagcttcttgatgaaataacacagatgcttgacgtcttttttcagcgcggcaagtctgaaggtgtgctccgcaatctgccgtccaatgtgctgatggcgctgctgctcggggcatatctcaaactctatcagcttatccggacgggaagcgtcgaaataacaaaaccgtttctgaaagaattggaacaatgttcttgggatgccatcagaactcattaactattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgtttcgaatttccgagctctgtcggggtcttcgtctcaggccgcgagctcgcggcagaagtctgtgatgaaaagcgatttgataaaaacctcagcaaagccttgctgaaagtccgtgagtttggcggtgacggactatttacgagctggactcacgaaaagaattggcagaaagcgcatcggattttattgccgagcttcagccagaaggcgatgaaaggctatcattcaatgatgcttgatattgccatgcagcttgtgcagaagtggagcagattaaatccgaatgaagaaattgacgttgccgaagatatgacgcgcctgacgctggatacaatcggcctgtgcggatttcattaccgctttaacagcttttaccgcgacacacagcatccttttatcacaagtatgcttcgcgcgctgcaggaggcaatgcgccaatcacagagacacagcctgcaggacaagctgatgatcaaaacgagacatcagttccagcaggatattgaagtgatgaatgaactcgtagaccggatcatcgctgagcggagggaaaatccggatgagaatctgtctgatcttttagcattgatgcttgaagcgaaagatcctgtaacgggtgaaaggctggatgatgaaaatatccgctatcaaatcattacctttttgatcgcggggcatgaaaccacaagcggactgctttcattcgcgatttactgcctgctgaaaaataaagataaattgaaaaaagccgttcaggaagccgagcgggtgctgacgggagagacacctgaatataagcagattcagcagctgacatatacccgcatggtgttgaacgagactttacggctgtatccgactgccccggcattttccctgtacgcgaaagaagatacggttctcggcgggaaatatccgattgcgaaaggacagccggtgacgattctgactccgcagcttcaccgggataaaagcgcgtggggagaagatgccgagctattccgtccggaaaggttcagcgatcccgcggcaattccggctgatgcgtataagccgttcggaaacggacagcgcgcatgcatcgggatgcagtttgccctgcaggaagcgacaatggtgctcggccttgtccttaaacactttgaactgattgatcatactgattatgagcttacgattaaagaagctttaaccattaagcccggtgattttaaaatccgtgtaaaaaacaaggacgtgtccaatcatcagcccgtacaaaaccataaagctgaaggcggcggtcacaaagaagaaacgaaagaaatcccgtcccacggaacgccgcttctcattctttacggatcaaatttaggaactgcggaaggaatcgcggaagagctggctgacatcggcagaagcaaaggattttcaactgaaaccggcccgctcgatgattatgccgggaaactgcctgtaaaaggcgcagtcgttattgtgacggcttcttataacggggcgccgcctgataatgcggcgggttttgtgaaatggatggaaacccttgaagatcaggaattaaagggtgtttcttacgccgtcttcggctgcggagaccgtaactgggccgccacttaccagagggtaccccgcctgatagacaaagtgcttgaagaaaaaggggcaaaacggctgacttctatcggggagggcgacaatgccgatgattttgagtacagtcaggaagcctgggaagactcattctggaaggacatcatgaaggcttttcatatagaggccgctccaaaacaggcaaacaaatcacagttatcaatcgaatacgtaagtgaagcagccgagacgccgattgccaaaacgtacaaagcatttgaggcggaagtcatcacaaacaaagagcttcataccgaaagcagcaagcgttcagtccggcatattgagctgcgtctcccgaagaccgaaacgtatcgggaaggagaccatctcggggtgcttccgcaaaacagcggggaactgatcagccgtgtcattcgccgattcggtctcgacccaaatcagcactttaagatcaagggccggcagctgcctcatctgccgatggaccggccggttaatgcgccggagcttttggcgtcatatgtagagctgcaggaaccggcaacgagagcccagcttcgcgaacttgccgcccataccgtgtgcccgccgcaccaaaaagaattggagcatctttattctgacgatgcggcatataaagaaaacgtgctgaaaaaacgaatgaccatgctggacctgctggaagattatccggcgtgtgaactgccgtttgagcgctttttagaacttctgccgtccttaaaggcgcgctattattcaatctcaagctcaccgaaggcaaacaaaagggagctcagtatcacggtcggcgttgtgacggctccggcgtggagcggccggggagaatacaagggcgtggcttcgaactatttagccggattacaaaatggcgattctgccgtctgtttcatccgctcgccgcagtcgggtttcgcattgcccgaaattacgaaaacgcctctcattatgatcggagcaggcaccggaattgcaccgttcaggggatttatccaggcgcgggctgcagaaaaaatgtccggtaacagcctgggcgaagctcatttatacttcggctgcagacaccctgaagaagacgatctgtacaaagatgaattcgaccatgcggagaaaaacggccttgtcaccgtgcatcgggcgtattccagattagatcaggactgtaaagtttacgtacaggatgtcctgcttcgcgaggctgcacagattattgcgcttcttgaccaaggcggccatctctatatatgcggagacggaagcaaaatggctccggctgtcgaaaatgtactgcttcaggcgtatgaaaaggtgcataacactgattcaaaagtttcctcgaattggcttgaacagctgcaggcggaaggaagatatgcgaaagatgtttgggcaggtgtgtaacagaagcgtaaggcaattgaagattgtgttttaattgaagaaagccggcacgatatttgaaatctactgaatcaaaaggaatagttatagggagtatcgtgccggccttatctttagtatcggacaaaagacacaaatctttaatgtttttattgatttacatgcaggcggctatgtcccttttttctgaattccgccagaaataaaaccggataagacagcaatagcaaaaccgaaataaatgaaatgataccgatccaatgaaaatgcgtccaaaagaaaccgccgcaagacccggccgcgcttgacccgatatagtatgcaagcagatataatgaagaagcttgcgcgcgctgatcaccggctgctcggccgacccaggcgcttgcaattgaatgtgcgccgaaaaagccgaaggtaaacacggcaatgcccgcaattttaagggcaagctggggcaaaagtgtcaccgctgcgccggcaagcataacaaaaatcgcaatcttaatcatttttgcacttccgaaaagatctgcttttttccccatatagacagagctgaacgttcccgcgagatagacaataaaaataaaaccgattacagtctgtgacaaatgataaggagccgccattaaatgaaagccgatataattatataatgtcacaaaactccccattaatataaatcccagagatattaacaaaagcagccgtttgcggtgtagaaccgctccgtattccttacatgccgcttttacgcccgcatgccgctgagatgaatggcgcggagccggaagaaaacgccaaaacaaatagcttaatataatagaaagaatgccgataatggcaagcgccggccgccagccgaatacatcagtcagaagccccgttaacagcctgccgctcattcccccgatgcttgtgccgctgatatacaggcccatcattttcccgaggcccttcggatcaaactcctcgcctacatatgtcatagcgacagcaggaacgcctgccagaaaaataccgagcagccccctcatcgccaaaagcgccggaaaagccggactgaacgctgttaatagacctaaaacagaagtggctgttaacgacagcaccattaatttttttctgccgaatccgtcagacaacgaagcagcggccaataatgaaaatgccaaaacggctgttgagatggataaagttaagctggcagccgcagcggaaatatgaaactcttccgaaaacaaaggcataagcggctgtgtcgtgtaaagcgtggcaaatgtcacaaagccgctgataaacagtgccaagctggcctttctgtaagcctttgtatgaggctgaataaacgtcatgaatgtccctcttttctcactgttggttatatatgtatcgtacgcttttcatttcaatgtgtctaatttataataactatagaattaatgcgtgtaggttatgaagaaaggggagaaggagaaaatggagcttcatcaaattgacaacttcattgcggcggcaactcatcagcatttcacaaatgcggcaaaagaaagaatgatttctcagccggcattaagccgatcgattatcaggctcgaagaagaattaggcgcgccgttattttacagagagacaaaagccgtccggctgacaaggcacggagagcagttcttaataaaagcaaaacaagcgagacgagctttaaatgaaggcgttgaacaagtgaaaaaaaatatgagcctggagcacggcgaaatatctgtatcttttcttcatacgctcgggttgcgcttgatgcctcagctgattgccgaatttaaaaagctatacccaaacgtgaccttccggctgtatcaaggcgcaaatgaaacgcttcgcaaaatggtggaaacgggagatgcggatatctgtctcagctccccgccgcttcccagcgagcttttacaatggacagtgctggagaaagagcctctttatgcggtgcttcctgagaaccacccgcttgcagaaaataaaagcattcaaatgaaagagatgcaggacgaggattttgtcggatttaaaccgggatacgggctgagatatatgtttgatctgatgtgccgggatttgaatatacacccgcatctcgcatttgaaggagaggaagtgtcaaccatattagggctgaccgccgcgggtcttggggctgcagtgctgccgaaaaccgcggagcattcatactttccggtcgtttttctcccggttgcagattaccaatgcgaacgcaccatagcgttagcccagttaaaaaaccatgctctctctcccgctgctgagcgttttaaacagtttgcacttgattattacaaagcacgcaactgagcggtcattttattaaaatcgaagttgaaaataaagcagaaagaaatacagaaaacggaggataaccatggcgaaaaaaacagtgaaaacaaatgctgtccgtatcattgagcagcaaaacattccctatgagctattaggttacaaaacagaagggggacagcccgcagacggtctttccgtttcacaaaaaatcggatactctgccgaatatgtttataaaaccttagtggcatctgcaggaactgatcgttattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttcctacttttattgatagatccgctgaaacactggcgtttatgattgtcagtgcggggaaaatcggaatgcagctaaaagtagcgcctcatgatttagccgaagcaagcggggcggtatttacagacattgtataaatgtccggtggatctaatggaatacacgtttcaagggagaatgataatgaaaaaaagatatgaaaacttgaatggcgtgaagaatgaacatggattcatggacatgtggaaatggatgaaagaacgaagagaaaaaagtaaagatttaagcgagaatattccgaaagcggtcacaagggatgtccgtgatgttgccgtcaatcggacggaaaccgccataacatggatcggccattcttcatttctgatccaaatacaggggcttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggattgaaaaagctgttcatcaaaaaaggccgcaaaaaggttcatgaaatgaattggtggggtcgttttgagatgcggggggtgaatatatcatttgttccggcccagcactggacccggagaacgctttgggataccgatacttctcattggggaggctgggtcatagaaagcgaaaacggcgagtccatctattttgcaggagatacaggctattttgaaggctttaaagaaatcggagagaggtttcgtattaaggcggccctgatgccgatcggagcatacgaacccgaatggtttatgaaagtgtcacatatcaatccggaagacgccgtgaaagcttttttagagctgaaggctgacagcttcattcccatgcattacggggcattccggcttgctgatgatacaggcccggaagcattaagcagactgcacggtgagtgggaccggcttgcattacctcctgaaaacctgagagcattagcgcttggcgaaacattttggctgtaacagcaggttttcgctgccgacaccaatcgtttaaaaacggttggtgttttgttgtcaaccaaaggtgaacagcctcagtataaaacatgatttttccggaatctgcggtaaaaaacaaaactttttactcttttgtttcactatacaatgaaaacggtttcgtatgcgcggtatatttaacctatcacaattgctccagcagaaacggacaggaaggatagaaaaacagatgaaatacatgaattcaagacagaaaaagattttgtatctgttgttatctgaacctgatgactacttagttgtgcaagatttcgcagacagggtccgctgttctgaaaaaacgatcaggaatgatttgaaaacgattgaagatttcctgaatgaacatgctcaagctcagctgatccgtaaaccgggattaggcgtctatttacatatatctgaacaggaaagatcacggttaagccggcacatttataatgagcactttacatgcaggcacaagaccgatgaagaaagaatacttcacatcgcttatgatttattaatgaattcaaagcccgtttccgcaaaagaaattgccgcacagcattttgtaaacagagcttccattaaaaaggatatcagtgcggttgaagagtggctgaagcgatttgatctcacactggtttctaaacagcggctcggcttaaagattgaaggggacgaaaaaaacaaaagaaaagcattggcgcgaatttcagatttgattgataatgcggagtttacaagccaatttataaaaagtaagtttttaagtcatgaagcggactttgtgagaaaagaaatcaagttattacaaaaaaaccattctatctattttacggatgaaacatttgaaagtttgctgctgcatacattgctgaccatccgccgtatcaaaatgaaacagccggtcgccatctctgcaaggcagctggaggcggtaaaaaagaagaaagaatatgaatggacactggcttgtttaaaacggcttgagccggtatttgccatccggtttcccgaggaagaagccgtctatttaactttacatataataggcgggaaagtgcgctatccattgcagcaagaaaagaagcttgatcttgaagattctgagctttccaaagtcgtcaggcatttgatcaatcgcgtttcagaactgaaaatgctggatttccataaagaccaggaattgatcaatggattgaacattcatctcgatccggtgttgaagcggctgagctatgatctctctgtttcaaaccccatgctccacgacatcaaaaaaatgtatccttatttgtttcatcttatcattgacgttttagaagacatcaatcaaacatttgatctttatattcctgaagaagaggcggcctatttgaccctgcattttcaggcagcgatcgaacggctgcgccgaagcagtcataaccctaaaaggacgatcatcgtctgccatatgggcattggcatgtcgcaattgctgcggactaaaattgaacgcaaatttcatcacattacgataaaagactgtatcgcaaaagcggaactgacagagtatatcaaaaagcataaagatatagatttcgtcatttctacgatagggcttggaaatgtaacgatccctcatatcgtcgtatcaccgcttttggagcctgctgatgaaaagaagctcagcgcatttatgcaacagcttgatacatcacaccgccgggagcaaaaaacgtttaaaatgctgaatgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagcccattgagtgggggacggaaaaggtgtcgcttgtatttatgcttgccgtcaaacacgaagatcaaaacaaggtaaagcaattattcagtgagctttcctatcttagcgagcagccggcatttattcaaaaactgacggaagaaaaaaatgtgatgacgtttttatcgtatttaaactattaaaagcaggggatggctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccagggcggaatcggggtggaaaataggctgaccgaagaggaaatccgggaagcagacgcaatcattatcgcggcggaccgttcggtgaacaaagaccgattcgcgggaaaaaagctgctggccgtcggggttcaggaaggcatccgcaaaccggaagaattaattcaaagagcgcttagcggtgaagtgccggtctatcaatctgcttcaaaaactgaatccgcaagtcagcagggcaaaaaacaaaacccgatttaccgtcatttaatgaacggcgtttcttttatggttcctttcattgtcgtcggcggattattgatagcggttgcattgacgcttggaggagaaaaaacaccaaagggcttagtcattccggatgcgtctttttggaaaacgattgaacagatcggcagcgcttctttttcattcatgatcccgattttagccgggtacatcgcgttcagcatcgccgataagccgggtcttgtccccggaatgatcggcggatatattgcggcatccggcagcttttacgacagtgcgagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtatttctgatcggcgcccccgtcgctcatattttcgcatcattaacggtttggcttgcgggaatgaaaggctcgagctcaattctcctggcattgattttaggagcgatgatctcctttgatatgggaggacccgtaaacaaggtggcctttctattcggatcggcaatgatcggagaaggaaattatgaaattatgggcccgattgccgtttccatttgtataccgccgatagggcttgggattgcgacgtttttaggaaaaagaaaattcgccgccgcagaaaaagaaatgggaaaagcgtcatttacgatgggccttttcggtatcacggaaggagccattccatttgcggcccaagatccccttcgtgtgatcccgagtattatggcgggttctatgaccggctcggtgatagcgatgatcggccatgtgggggacagagtggcacacggcggccccatcgttgctgtacttggagcagtagatcatgtattgatgttttttatcgctgtaacagcaggctctcttgtcaccgctctgttggttaatgtactgaagaaagatatggcgaaatcccccgcgcccggtgaggtgctgccgtctgccgcaccaaatgaagctgcagcggcaaaagaaacaaaggaaccatctcaggctgacagccgaaaagccgggatgaccgaaatcaaaaaactgactgacattatcagcacggacttgattgaaccgcatttatccggcgaaacgagggatgacattatcgatgaaatgatcgagaaattgtcccgtaaaggtatgcttctgtctgacagcggatttaaacaggccattttgagccgtgaacagcagggaaccacggcgataggtatgaatatcgccattccgcacggaaagtctgatgccgtcagaacgccgggtgtcgcattcggaataagacgttcgggtgttgactggaacagccttgatggttctgatgcaaaactgatttttatgattgccgtaccgaaggaaagcggcggaaatcagcatctgaaaatattgcagatgttatcccgaaaactgatggatgacagctatcgggaaaggctgctctccgttcagacaaaagaagaggcgtatgggcttctggaagaaatcgaataaagcgggggatgatcatgtctactgaaccgatatttttcaatccggttttcaaagaaagaatttggggaggcgccgccctgcgtgatttccactataatattccgtccgagcggacaggggagtgctgggcctttgccgctcatcaaaatggacagagcacagttcgaaacggcatgtataaaggatgtacgctcggtgaattgtgggagcatcacagagatttattcggaaaccttgaaggagaccgttttcctcttcttacaaaaattttggatgcggaccaagatctgtccgttcaggtgcatccggatgatgactttgccaaaatgcatgaaaacggggaacttggaaaaaccgaatgctggtatatcattgattgtgaaaaagatgcggagatcattttcggccacagcgcaacaacaaaagaagaactgatatccatgattgagcgcggagaatgggacggacttctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgacagacgttccatctgtccgtgaacggccgaccgttcaatataaacaaacagatgatctgctggcagctgttttaatagaatgtccttatttttcagtcgaaaagtgggatgtaaaaggtgaagcgaatttattccagaatcatcccttccttcttgtcagcgtgatcgaaggagacggaataataattgcaggcgggcatgaacatccctttagaaaaggagatcacattctcctgccttccggtttgggagaatataaactggcgggccatgcaaagtgtattgtgtctcatctgtaatcttcaaaacccttctctggcagcagagaagggtttttcatcacttttacaaaaaggccgaaatttccgtggtccgttcctgaatttaatctctcaatttgtatatctcccgagccattgattcaagtatgtacatagcggggatttgggtggtgatattcgcattttcaacccattcttccgtcacgtaatatgaaatattcacatcagacattttggcaatggttgaatgtttatgatttgtaatactgatgacccggcttccttcttgtttcagctgattcagatgagtcaccgtagaatctccttcacctgaaaccgataatgcgatcgtgatgctgttatggcggaaatgggaatgggccggaaagtaaggatctttaatatacattgaaagtttccctaagcacgaaaaatatctggctccgtattcggcgagaattcctgaactacccactccgataaaaatgacgctttctgcatcggctgcaagggctgctgcttccttcagcttttcttccatccctccgcttactgttctttcaaaaaactcggcaacggaatgatggggactctttaaaatcgtttttttatttgcctccgcatacattttcagcttcaccttaaactccgaaaacccttcacagtttatttttttgcagaaacgtaaaatagaagccgtcgatacatgggtttcatttgccaattcacggattcgcatatagacgactttctcgctgttttgggagatgtagttgtataaagaagtttcaagctcgttaaatgaagcaatcatttcgtgtgtgaacatgcagggggattctcctttttatgagaatggtgaatgtacatctcatcgtaacatatcatttttaaaagaaacatagtgttatatttatgtgacaaatcactttttgtgtcattcaaaacaagacgtcagccaatgatttacggtgcaaaacaactgcggatataattcgttcatacgcttatgcatgatctcttcaagggtctctgacaaaagcggtcgaaaaaaggaggacaatatgagtatcaaactgatagcggttgatatggacggaacgtttttgaatgatgaaatggcatataacaaagagcgttttatgaatcagtatcgtgaattaaaagcgcggggaattaaatttgccgtagcaagcggaaaccaatatgcgcagcttacatccttctttccggaaatcaaaagtgaaatcgctttcgttgccgagaatggcgctttcgtcgtgaatgccggagaagaattattcgcgggtaacatgtctgaagacactataaaagaggtgatccgtgctttagagcagtatgaggtgaaaaacgtcattgtctgcggaaaaaaaagcgcgtatattcatgaaaatgccagtgaggatgaatatctgcatgccagtaagtattattatgtgttaaaaagggtgccgcattttgaaaacatcgatgatgacattttaaaattttccatcagttttcccgccgaacattgttccgcacttctgaggcatttaaaagacgccatcgggtctttcgtcacgcctgtatcaagcgggcacggtgacatagatctgatcataccggggcttcataaagcaagcgggattaggcttctccagaaacaatgggggataaatgatgaagaatgtgcggccttcggagacagcggcaatgatttggagatggtgtctgccgtgaaatacggagtcgctatggataatgcgcaggaaagcattaaacaggccgcggcgcatatcgcgcaatcaaacaatgaggaaggggtcttaaacgcgattgattccattctcaaatgtgaaaaaccctttgtctgaaaaagacattttaactgcggaggtgctgaacgatgattaaattagtgattacggatttagacggcacatttttaaataatcaaggcgattttgacagaacgttatttgaaaagacaaaacgagtaatggaagaacagcatgtcgctttcgccatctgcaccgggaaacagtgtgaaagggtggaagccttattcggagaagacgcgaaagatttttggattttaggagacagtgccgcacgtatgaaaaagaacggcaaattcgtatatgaatctttgatcagcaataaagccggactgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactgagataaaagacgattttatcaagattacggttcatgaccccgacgccaactgtccggaaacgagagaaaagctgcatgaattttttcaccaattatatatcgtagcatcagaagatacctggatggacatatcaaatatcggaatacataaaggatcaacagtacaagaactgcagcgattattaggggtttcggctgatgaaacaatggcattcggagacggccgcaatgacaaagaattgatggaagcggcttcctacagctttgcggttaagaacgccattgacgaaataaaagatgcggcgcactttgtcatcaaatcaaatgacgaaagcagcgtcatgcacacgattatgagaatattagcgctgcaaaaacaatgagaaagcagatgggctaaagccaatgcggcaggacttactaggaaaagaaaaagcgggctatcctccgactttaaatcactcctgattttccgaaaatatgttaaaaatgaataaatatctatatttgacccaattgtattggtataatatgtataaaatgaatgaaacggcgtaatatcaagatgaaataaatcacttcatatcatttgatatcagacaaaaagtaggaacttcctcgttttgaaattgggaggtgtttgtattagcccgctgttgagtcccgcgtatatcattctcatttttcttccagcagcttcttttctgttagggattttaggatatttcatcttcaaaaaagtatggatgatggttgttattgtattcattttgtccttgatatttatgtttattgtaataggtgccgaaccgacatttttcatttgggtggctatgatgacggggagctgttttatctccggttcaatcactaagacggtatggacttttgtaaagcgaaaatattagacacagaagaatcctgtttgaacagctatccttttttgccgattgaagaaaaggaagtatagagtgatctgttatgttcttatattttgtctgttattgtattgtctgtgtatcgttttgttcttttttaactaaacggagcgctataattgaactgcagatatatagaaacacaaaaaaggataaggaggatttttatgtttcaaaccttagaccattttttgaaatcttgggaattcgaagccgatgcgacacaaaaactgctgaatcatctgactgatgaatcacttaaacaagaaatcacttcacaacattggactttaggccgtattgcatggcatactgtcgcggccattcatatcattacctcgaacacagatttaacgttccacgctccggctgaagattatcctgttcctgcatcggcgcggtttattgctgagagttatcatcaagccagtaatgcatttgtgcaggcgttaaaaacgcaatggactgacgatacacttcaagaatgtgtcaactttattggtcagcaattgccgaatggttcacttttgatgtttttaattcaacatcaaaaccatcatcgaggacaaatgactgtccttatgagacaagcaggtttacctgttccgggtatttatggtccggcaaaagaggaatggacaacatttggtttggaagctccgaaataggatgttgttgtaagggctcgaacgaatagatgataccaatcaatgttggtatcttttttgtattagtcttcgtgacatgcagacgaatcaacagttcaaaaggtgtaaagtgagttcaataactgcagaaaggcgattatgatgataactaaaatgactcaattcaatatgaaagacttcaataaaccaaacgaacctttcgttgtttcagggagaatcatcccttcatttgaaaacaatgtttggacatatacagaggagaaatttgctgaaccttatgtcaaaaaatatgacgatgaagacattgatgtcagttatgctgaagaagaggataaagttgtctttttttattacgcagagaacgactgtgtcggccggagtaagcttcgttctaattggaatggatacgcactgattgaagacattgccgttgcaaaagattatagaaaaaatggtgtcgggacggctttattacataaagcgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatataacagtatttgatgtttcgtcatttagcgggtgtgtgccgcaaagtattcaaaacatcggcttgaggatttataataaggtatatcaatcaatgcagggggagttatgtatgaagtgcaaaaaaatgaacagggtacaattaaaagagggaagcgtatcaatggccctataaactgcgtctgccctcattaatggagggaaatttgtgaatacgccttattcacagtcagctttacggcacaaccaagtgttcatttggctttgtgttttgtcatttttcagcgtattaaatgaaatggttttgaacgtctcgttacctgatatcgccaacgattttcataaactgccagcgagtgcaaactgggtgaacacggcttttatgttaacattttccatcggaactgctctgtatgggaagttatcagatcagctgggcatcaaaaaactgctcctatttggaattatggtaaatggcttcggatcgatcattggatttgtcggacactctttctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgtcggaccagctatcggcggaatgatcgctcattatattcactggtcatatttgctgcttattccgacagcaacagttatcaccgttccattcctgatgaaactgctggaaaaggaagaaagaatcagcgggcgctttgatatgacggggattatattaatgtctgcaggcaccgtattttttctgctgtttacaacgtcatatagaatgtcttttctgatcatcagtattctggctttcctgatatttgtgaaacatattaggaaaactcaagatccctttgttgaccctgcactggggaaaaatgttttgtttatgacgggcgtccttagcggaggcctgatattcggcactgctgcaggatttgtgtctatggttccttatatgatgaaagatgttcaccatttaagtactgcggcaattggaagcgggattatgttccccgggacgatgagcgtcatcatcttcggttacattggaggattgcttgttgatcggaaaggttctttgtgtgtgctgaccattgggattgtattgatgtcttccagctttttaatcgctgcctttttcatagatgcggcaccttggcttatgaccgtcataatcgtttttgtgtttggggggctctccttcacaaaaacggttatatctacaattgtgtctggcagtttgaaacaaaaggaagccggcgccggaatgagtctgcttaattttacgagctttttatcagagggaacgggtatttcgattgcaggcggtttattatcgatcagcttgctgaatcaaaggctgctgcctgttaacgatgatcattccgcttatttgtacagtaatatgctcattctttttacaggaatcgttgttatgagctggctggtaaccatgaatgtctataaacgttcgcgaagaaatgactaaaaagggaaaaggatcaaacttgataaaagttttgatcctttttttaaggagcttccttattacggaaccttttgccgatcaatgaaaggggcgttaaagtgaattacatttataagaaaaaggaaaagaaaaatggaaaattgtatcatttcaatcagagataaatgggagaatgcacttattgagtctgaacaaaaaaataatcgtaatcaattaccgtaacgagaaaacaaccaagttttcactgccaatcgagacttttgaaaaagtgtatgaggatattaaaataggccggagagaaagttaatcactgtttgaaaatgactatgaagttcgtaagcggtatggttttaaccgcatctggattcccctggcaaagtaaaggtctttagggatttatgtcaaaataatagtaagtaccttatgcaacagggagtttggttgcttcataaggaggggaagtatgaaaaataagattcacatattgggagcctctggtgtcggaacgtcaacattgggtgttgcattatcaaagcatttgccgcatacgcatcttgatactgatgattactattggacagataaattcactaaaaaaagagaaatcgctgaaagaagaaagttacttaaaaaagacttgacaataaatgagaaatggattctttctggcgcagtgtgccgctggggcgatgatctaaaaagttattttgaccttgtcatcttcttatggattccgcaggatatacggcttgagagattaaggcatagggaatttcagcgttatggaaacgaagtgttagccggcggcagtaaatatgaacaatcaaaaacatttttagagtgggcttctttatatgatcattccggaatggaagttagaagcaaagctttacacgaacattggatgtcggatttatcttgtccattgttaaaaattgaaggagattactcagtcaatgaaagagttgatcgtgtcttggattatctgaattctaattaaactaacggatggagataactgcaaaatccaaaagtcaaagacagttccggccattttaacggagctgttttttataccgccttcagtttgtctgttgtgaagtgatttattctcggaaagaagcagcggaattaatagagaactcacttcgggaaaccgtgaaggcaggaatcaaaacgggagacttggcggtcaatcatcaacgtcagactttgcagaagaattgcagaaatgatcggatgttaaggcggaaaataagaagtgagaagcagatcatcaaaacgcaatacacctcaatttatattttcagtaagatcggctctgctcattaaaaaactcaattcgaagattagcggcatcaatattgccgcagatggggttagtgacataaagaggaagggataagaccccttccttaaaacctttaattcctctaatttcattgtcagatatattccttttttgaaatgggtatccaaatttcacttttaaaagatggcgatgttacatccttatgctcgttccacaggatttctgggccttcaatttgttcataatgtgacgatggaaaccattcggaataaatccgcccccatacttcctgcagtgcatccggaaatgatccggctgcttcgaatacagcccatgttgaggcagggacttcaagctgtgataggtgatttgggcaatgtttcgttgtggctgcgccaatatagtgatcaagctctccgttttcctctgtcctgccttcagaaaagttcgtggatgcactgatgagtcctgcaggcgctgtattagaaagctcttttagttgtttgattgctgcttcatctaaactttcccacatcgatgcaatgtcaggattcacgcctttgaacaaaatagggactctttttttaatgccgacgatgcgaaatgcctctttttcttcaatgcgatagttcatttcatttcctcctttgattgataactggaaggtcattcgcggataagctttaagtgaatggccattatgtttaacttctgatgggtttatgccatgcagattttgaaatgctcgtgcaaaagaatctggtgagtgataaccgtattttattgcaagatcaatcacctttacgcggctgtctttaagttcaaaagctgcaagagtaagacgtctgcggcgaatatattccgataatgaaatacctgtaaggaaggaaaacatccttttaaaatgatattcagagcagaaagcaagccttgctgcttctttgaaatcaatagcgttcgtgaggttttcttcaatatacgttaatgcgctgttcatccttttaagcgaatccatttatttgacctcctttaacaaaagaataacaggagcgaaatgtatctgcccgacatttcgtgcacagttttgcaggataacttatatgtaataaattaagttactcacctgtatttgtacagataaagaaaacacctaataactgcttgggtttcataagatgaaagaaagttatcattgttttatattgaaaagaaaatagaaaaagacggagttttcttgcgggaggggtttactatcaatcaattgaaagctgcatacgcggaggcagttaaaaaattttagttgatgtcgagaacgatgttcatcttcactgcttgttcaattagaggaagtgattcttccttaagggagatcactttttttattcgactaaagcagcagtttagcggaagaaggagaaaaatcagttgacttacttgaatactgaataggtgtaaaaagtggttattcatacggattgaaaaagaagaacacgcagcagactcacttgctcttgtttggggcaagtgttgacaaccctattagctggtttaattaaagaaggggtataaaacctgtatcaatgatgttactagatatctgcgacacaggttttatatttagctaaaatattcttatatattccacattgcatttttttattatgcaatagttcactctatttctgctttcaatttttcgaaccactctaaattaaccaagtgatgtgaacgggaattttcattcatacggcgaaagtaattgattgtgccgggaatttcttgagtgatggacaggtattcatcaaggagctcgattcgagttttagtctgatcgatttgtgattggatcagttccagtaatttatttttgtcgaattcatcggcaaagagtaacgccccataaaattgcaggttcacatattccgatttggtgccgtatttgatcattaatttttcaaattctgcccttcccgaatctgtgactttaaagttacggatttcacgcccgctggttgagggtttctgctgaatctgttcaatcaaacacttttcttcaagttgctgcagattgtaataaaatgaacctttcgtgaagttaacaatgtatttgtaatgacgtttttccattaaggccagaagttcatagccgtgagctccggggttttggatgagcaagccaaggataagtaagggaatcatggtttcatcaccttctccatccgcgcctcaaattccgcgtacgtgattttacccgaagccaaatccatactatgaaggtaaatctgttctgttttagaatagtcacccttcactttcagtgattgctcctctcccgaaatgggtttcaggatatggtgctttttcgagaaagcctcgaaatagcggtaaccgaatttgcgttgtgaagctgcgtctaaatgaatgccatcaggattcgcagtcaaacctgcagcagtaacaaaataacaattctgttgttcattagcaaaacgcagcaattgttcattaacctgtcgaaattcagtcgcgtgctgtccaaaaccggtcttcccaagaaagtcaccaagccctccaataatcaacggtacatcatcaagtttcaactcgtttcttagcgtctcaatgataagagttaatttctcgtaataagtttcatgcagcgaacgataactgtcactctcaccttggtgccaaaggattccgcaaatttgactggaacggagggcgaagcgggcttcggacaaagcatgctgaaaaaggatgccttccggatgccagtcattcaatgaactgccgccttccgcacaagggatcaagccaatttcttcatcgggatgagctttcgaccaagcatctgcaaaagatgccgccaagccaacgccggaaaccggacggtcgtaattaatcggctctgtcatcatctgccactgtccattgcgcagcatttttattttttcattatagatagggtctacttcattcaaaaatccacggcccgccatattcgactgccccaacattaaaaaagactttatcatttaatttttcacttctttacatcaatattttagtctaattagactatagtcaattcagcttgtcttgtaaagttctaataaggttttacttttattagtagtatgtatgaaaagcaaactaacattgaaaatttggtggatgtatttgagaaatagcaagttcttttgctttagatcttgataaacaatgaaaaacaacaaaaatcctgtcatgtaagggttcctatgaggttcaaaatcattaaaaaggttaacgattgtaccaattctattcatttgttatgttttacttttaaatcctgaagttatacttgaagaggaatgtcctaaaatgcagaaaaagccgggatgtcagatccggcttttcgctcactttcctttcttcttccgcttctccttttccgcccggtaaaactcatgaaacatcttcatcaatgcgcgtttttcaatccgcgacacgtaactccttgaaatgccgagctcctttgcgatctcgcgctgcgttttttctttttttagatcaagcccgaagcggccgacgatgacttctttttcgcggtcgtctaaaatatcgatatattttttgaccttttcaagttccatgttgagctgaatggtgtcgatcacatcctcgctttccgacttgaggacatcgatcaggcttatttcattcccttctttatcctggccgatcggatcatgaagggagacgtcttttttcgtttttttcaatgcgcgcagatgcattaaaatctcattttcaatacatcgtgcggcatatgtggcaagcttcgtgccttttccggctgagtagctttcaattcctttgatcagcccgattgtaccgatggagatcagatcttctgcgtcctctcccgtattttcgaattttttcacaatatgggcgactaaacggagattgtgttcgatcagcatgttgcgggcatgttcatcgccttcagccataaggtctaagtattttttctcctcactatttgagagcggttgtggaaaggcattatttttcacgtatgatactaaaaacacgagttctttcacaataaacccgagcgctgcaaaaacacctgtcaccatcctcacctccacaaagttatgtaggcaaaagcctatatgtaactgtatgtggcagtcaggctgtttgtgtctgtacagggaaattaatcaaaggcaggttttatttcttacagcctcttgatttttgctgattgagcctgtatattgttaaaaaaagtaagggtgaaaagaatataacgaaaagcgctgaagagacgagtagacagatatcattcatgacagagagctccgggagctgtgaaggagtatgaatggatgtgttgaaacaaacctcttagcttcgcatcggaatcatgaaaaacgaggatgatgcggcggatactcctgttaccgagtaagttttgtacccggcaagaggccggcaccaaaccgaattgaggtggcatagcgggctgtttcccgtcctcaagactttattgtcttgagggcgttttttatttctaagggagggataagatgaaaaacctgaagtcttggcggtacccgatgcttctgttaaccggaatcgggatagcaaatattggtgaatggatttattttttgtctcttaatcttattgttttaaaagaaacggggtctgcttttgcggtttccatcctttatttaatcaggcctgcggctgttttgatgacaaatgggtgggcgggcagcatcatcgacaggtgtaacaaacggaatatgatgatgtcgcttgatttcatccgggctgcattcattgccgttctgccgctgatgtttactgtaaggtctttgttttccatttattgtatcgtgtttttgattcaaatggccaatgcgatgtttcgtccgtgttccatggcgtatgtgacgatgcttattccggctgaaaggagaaaacgattcaattcactaagggctttgtcggaatcaggggcttttctcctcgggccggctgcggccgggctgctttttatcgccggcacgccgatttttgcgatttgggtgaatgcggcggctttagtgctgtccggtttcatcacgatgatgctgccgagccttgaaaatgagcctcacgtacattctcccagacagaagctttctttggcagtgtgcaaagaagattggaagctcgtctatcgcttcagccgaacggcgcgaaacgtcatgatcatttattttttattcagtctggtcatgaccgttatgccatccgcgcttgattcgcttgaagccgctttttcaaaagaagttcttcagctgactgatgccgattacggttttcttgtcagtgtctcaggggcaggcattattgcgggggcgcttgtcaatgtaatctttaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatattggtaacggcggttttcggagcggcggctgtcggttcttccgtccgcgtcatcgtcatcgcaggggctgctgttatgctggcgttggcagccgttttatgctcgttcttatttgcggcctcaaaaaggaggactcccgatgtgtttcaagcggatcaatttaaagaaacataaagagacggccgtttcatttcgtgaggatgagtatctcaggtggctgtcatcccaaatctaatgctcacccgacaattttaagctgcttcttcataacgggcagccgatcggacagcttgaagcttccatcaacttttaccgcagccaaaaaatcggttatgtgcacctttactgagcagcaaagagaacgcggaacgaagctgcatcaatttagaattaaacggaaaagttctcagaatgagaggagccgtaccgccggaataggaggcggtacgcgcttcattttttcgttgtttttaaaagaccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcgtatgttactcagcccgcagacggtattcatggcaagcgacggtataatcggaatcagccgcccgaaaagcaccgccgtaaacgcgtgctgatgaaatgaaccttcatattgagccgcggccgggtaagccaccagtttttttctggcccagtctctgaatccgtaccggacgagaaaaaacaatgccattgttccgagcattgcgcctgacaatgtaatccacactccgtttacaatcccgaaaaccgctccgtttaaggccgcgataatggcgaatggaacgatcggaaaaaatacgtcagctgcgaccagaaggatactcataagcacggcatacatgccgcccgcgcgaatcatgctgagccagacgtctttttgcataaagccgatcatcacgacagcaatgatgacggcaagactgaatcccttttttatcatctgtacgttcacctcttttcaattagtatacagcacaaatctatctccttctattaaaataagctgtccgataagcgtacttgtttatcagcatttgccgtttgatgagaaacggctggcagccgggtttggacaaaaacatgcgggaagcgggtgatgtgcatcatttgatgcagagaatgattttatacaaaaggggacacgttaacagtagtgtttactggaggtgtaaacgttgagatgctttcatctgatcatcatgatatgcgtcctcacgggtctcactgccgtgtccgccgatgcgaaatctttaaaaagaagtgacatggagaagacgggaaacgtgtactgggatataaggtctgaaaaaaagaagctatctttaaccttcgatgacggcccccatcctgtctatacggaggctgtgttagacgtgctgaaacagcacaatgttaaagcaacctttttttgtatcgggagccgtatagacaaataccccgtaacggcaaaacgcatcgttgaagaagggcatgaaatcggcaaccatacgatgaaccatgtttattttcaccgtttaaaacgcaaagacattttacaagagcttcacagctccgcgcatcatatcagatcgctgcagccggaaggggacaagttattccgcccgccgggagggtcgctgaatcatacggctttcaaaagcctcttaaaagagggctatcatatcatcatgtggtcatggaaccaagatccgagggactggaaaaggcccggaaaaggaaaaatcgtcaggcacgttgtttcacatgccagagatggagatatcgttcttctgcatgacggcggaggaaaccggcgccagacggttgaggctttgaaagaaatcattccccagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataacctgtctgttatcaggatgcgctgcgggcaaagagaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgctttcaaagcgacgtgctggagcgtaagccccaatatttatttatcatgttcggaacaaatgatgcgggcattttgacgggagatcagccgcgagtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaacatggcataattcctataacggcgttacgaggcaggttgcagctgagttgaaagtgccgctggtggataactggaaacactttatacgcgcggacggcggcaaagatacagaccgggcgctgatccaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatcttttggaggcgattgctatgaaccgcggtttccctccgcaatatcctgtatgcccgcctcctcgggtgaatgcggggtactggtacgcattttttgttgtgctgctcgtcgtcattctcgttctgggcggtctgtattggttcaatatatagcagccgtcctcttaaacacctctattttaggggtgttttttgttgaaagtggtagtaatgcgcataaccgaagtgatataatatcagtcatctgagtaaaaaaaggaaattcgcccgggaattttttctgtttaagaagaaacggaaataatgtgtccgagcgatcttcttttgatttcgttttcaattaactcgataaattcacggctcaaattcatttcattggctttgaaataagattctattagtaattcatcagaaagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacttgttagtatcttgtttataatctggataaatccggatgtaataagagtggataatgtgtgtaattttatccacaactggtgaagaaacccaatttttgtcgaaatttttttaccgagtccgactttgtttttaaatctgacagatttcgacatatagatgatagaaagaaaaggaagggtgcgggttttgttaaaaaagttttttttacctgacgaatttgtgaaaaatatatttcatatcacaccggaaaagctcaaggaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatggggcgcgcctttaaaagagctgtcagcagcatggagctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattaggaatggaaaaggttgtttgcatcggctgcggagtaacgatccagaccgaggataaacaaggtctcggatacgcgccaaaggcatcgctcacgaaggagaatgtcatttgtcagcgctgcttcagactgaaaaattacaatgaaattcaagatgtttcattaacggatgatgactttttaaatatcttgcacacaatcggcgatactgactctctaattgtcaaagtcgttgatatttttgattttaacggaagctggataaatgggctgaaccgctttgtcggcggtaatccgatcattcttgtcggtaataaggccgatatcctgccgaaatccgtaaagcgggaacggctcgtccaatggatgaaacgcgaagcgaaagaatacggcttaaaaccccttgatgtctttttaatcagcgcttcccgcggacaagggatgaaggaagtcattgacgccattgaacattaccgcgaagggcgggatgtgtatgtggtggggtgtaccaatgtcggcaaatccacatttatcaaccggattattaaagaggtctcaggggaagagaatattattaccacctctcaatttccgggcacgacgcttgatgcgattgaaatcccgcttgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtctgctatatgccgaatgaattgatgattcacagaacaaagcttgaaaatgctgatgccttatacgaaaagcatgcgggagaactgcttaccccgcccggaaaagatcatttggatgaatttccggagcttacggcccacacgtttacgattaaagaaggaaagacggatatcgttttttccggactcggctgggtcacggtgcagcaagcagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcattatctcaaggacgccgttaacggaatcaaggcgcttggcatctgcggagtgaacgtcacagtcccgcataaagtcgcgatcatggagcatctggatgaaatacatgaaagcgcgaaagtactcggggccgtaaataccgtcaaaagagagggagacaggctcatcgggtataatactgacggagatgggttttataaatccttagtcaaagtattggacaaaccgatatcagagctctccatcctcatgattggggcgggaggggcggcaagagcgatttttacgacgatcgtccgcagagagccgaaacaatttgacgtttgcaaccgcacgccggaaaaagcggaaagtctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggctgcactgtctttcaagctgtggacggaacaagagcctgacagcggcttaatgagagcaattgttgaaggaaaactaggaggaacacaatgttaacaggaaaacaaaaacggtttttgcgttcaaaagcgcatcatttaacgcctatttttcaagtgggaaaaggcggagtcaacgaaaacatggtgaaacagattgcagaggctttagaagcaagagagctgattaaagtcagcgtgcttcaaaactgcgaagacgataaaaacgatgtcgcagaagcgcttgtgaaaggcagccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatcccgccgcataagcagaatgaagactttacagacagccggcaccgggtggagatgctgaagcttgccatcagctctaattccttctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaactggacgaactgctcacgctcattcaatttatcggagtgcggcgcccagggtatcatatcgagaccccgtacccgctgctttttgccgacgttccggaatttgacgtttcgtcaacgatgcttagagaacgtctcaaagcaaaaaagccgacgcaatacttaatgccggataaagtgaggcagtatatagaggagaatgatttatatgaatcgtgaggaagcacttgcctgcgtcaaagaacagctgaccgagcatcgctacatccacacaatcggcgtgacagatacggcggttattctcgcaggccggttcggagcagatccgaaaaaagcggaaatggcggctatttttcatgattatgcgaaattccggccgaaagaagaaatgaagcagatcatcgtgcgggaaaaaatgcctgctgagctcttggattacaatgccgagctgtggcatgcccctgtgggagcgtatttggctgagaaagaagcggggatcactgatcccgaggtcttggatgcaatccgctatcacacgtcagggcgtcccggaatgacccttttagacaaagtcatctacgttgcggattacattgaacccggccgccattttcccggagtggaagaggtgcgccgtctggcggaaacagatctgaacgaagcgctcatacaagcgatgaaaaatacaatgatatttctgatgaaaaaaaaccagccggtctttccggagacgtttgcaacctataactggctggtgtctcaaaaacgacaggaggaatatggaaaatgaatcaagcttccgtattaaaaatcgcggcaaaagcatgcgacgataaacgtgcagaagatattttagcgctggacatggaaggaatctcacttgtagcggattactttttaatctgccacgggaattctgataaacaggttcaggccattgcgcgcgaaattaaagatcaggcagaagaaaacggcattgatgtcaaaaagatggaagggtttgatgaggcccgctgggttttagttgatctcggcgacgtcattgtccacgttttccataaagatgaaagaagctactataatcttgaaaagctatggggcgacgcgccgctcgcagagcttgaactcggcttgaactcatgatttaccaaggcttcgccggtgtatatgacgagttaatgtcccatgcgccgtatgatgaatgggcgggctggatcgaagcgtctcttccggaaaagggaagggtgcttgatcttgcctgcggaaccggagaaatatccatcaggcttgctgaaaaaggctgcgaagtcacggggattgatttgagtgaagatatgctgagctgtgcccagcagaaaaaaacaggaaagccgattctttttctccagcaggatatgagagagctttccggttttgaagaacagtttgatgccgtagtcatctgctgtgattccctaaattacttaaaaacgaaaaatgatgtcttaagcaccttcaaaagtgtttttcaagttttgaaggagggcggcctgcttctgtttgacgtccattccccgtataaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgctatgacgagacgcatgagcaaaaaacattttacattgaagaatataaacaaatgcttgcagagaccggatttgaattgaagaaagtgacggctgattttacagaccggcctccttcaacagagtctgaacgtcttttctttacggcaggcaaaccaaaaaccatcgtttaaacggaacgatggtttttaaaatgcattttttgcgattggcgtgataaagctctttatggcatactcagttacacgtgaaattgcttcttcactaacgatatatcttcatcgtatttgtcatgtgtacgctgaaagacacgattgaacatatcctgaacaccgctttcgagagccttcagtccttctccggtgacgccgccttttacgcatactttttcctgcaaggcgggaagcgtgtaatgccccgtttcaagaagctttccgagaccgacaagcatttctgtcgacataatcacggcttcttctttggtgatgtccgtttcttccactgccgcgtcaataaagcgctgaacgagataactcataaaagcgggcccgcagctgacaatgtctgacgccgctcttgtaataccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggagattaaaatgtgatctttccgtaaatgcggtgtgagttttttcagcaaaggatatatatccagcggttttacacaaatgaatatgatttcattatcctgtacgagcttttcctgatcctcggtgacgtggatgccgctgaaacgttcttttagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggatgcggcggaacctgaaaattctgggcgcttgtcttgcggcaggtgcggtttttatctgtatttggctgtttcgttctgaaaaggaagagccggtcaaacagcagtccgtgctcggtcaaacagcctccgcatccgtcgcggacaaaaaagacaccgcagacgataagattatgattgatgtgaaaggagcggtccgaaatcccggcgtgtatgaaatgaaagcgggagacagagtgacgcaagccattgaaaaagccggcggcctgaagaaaaaggcggatgaattgaatgttaatttagcagagcagctgcaggacgggacgattgtttatattccgagtgaaggcgaagaggagaatcgcccgaaaacagcagttggtgaaaaggagaatgcagctgtcaatatcaatacggcatctctggacgaacttcaggcgatttccggggtggggcagaaaaaagcggaagctattatcgcctaccgagaagaaaacggacggtttcagactgctgaagatttgatgaatgtatcaggctttggagaaaagtcatttgagcggataaaaacttccattacggtaaagtgaattgacggttctgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagataagcggatgattgctggcggatacaacggctcaatcgccggcggcgtccattgcgctgatgaaggatgccttttaatagataatcattgccagaggaccatacatgcagagatgaatgcgattctgcaatgttctaagttcggtgttccgacggagggcgcggaaatttatgtgacgcattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgaaatgatcatcgatctgaaaaaccgcgaaaaattgtcttttgtcgcaggtctgattcagcaattatctgatgcgggagttaaggcagatgaactgaaaaaaattcatgaacaggccaatgagctgtttaccagttacgtataaatgaaatataaataccttcttctgcctctggcggcggtttctgcaactgcggggattgccgccgctcatgtcttctgggttctgctcctttttcttctgtatcttctctttattatgataaaaacaaagcagcctgctccggttatcatctgcctcgtttctttttgtgtttatttctttctttatacggtttgtgacgctgtgaatgtaacgcggtatcaggccggcagttatactgaacaggccgtcatcactaatattccgaaggttgacggagcgaaaatgtcagccgttatccgtacacatgacaaggaaaaatgggcggcttcgtacaaaatccggtctcttgaagaaaagagacgcattgaacagcttgaaccggggatgcgctgcacatttacaggctctctggaacagcctgcacatgcgacgattcccgggggttttgattataaggaatatctttactctcagcagattcactggttatttaccgtgacttccattcagcagtgtgaaaaatccaaacagccgctgtttaaactgctgagcatcagaaaaaatttgatttcgatcattcggaatcacgtgcctgaatcttccgccggaattgttgaagcgctgaccttaggtgaaagattttctatagaagacgatatactgagtgcatatcaaaatttgggagtcgttcatttaatggcgatttccggaatgcatgtcggtcttataacggcgggattattttatgctctgatcagaatcgggctgacaagagaaaaggcggggatattgctgctgctgtttttaccggtgtatacgctgctgagcggtgccgccccatccgtattgcgcgcatccctcatgctgggattttatatcgccggaactcttgttaaacgcggcattcattcctctgctgcattgtctctgtcttatctgctgctcctgctgtttaatccttacctcctttggcaggcgggcttccagctttcctttgcggtaagcgcctctttaattctgtcatcctccattttaaagaaagcagggaaaagcagacttgccgggcttgcgatggcttcattcattgcagagctcagctcacttccgtttcttctctatcattttcagcaaatttcacttgccagttttccgatgaatatggtgatggtgccattttatacgttatttgtcattccggtttctgtcatcggtttccttcttcttttactttcaaggcagatgggagaatgtttgtttaatatgtttgaccttgtgatgaagcctgtgcatgatttcattacatatgcggcatccgttgatttatttactatgattgtgttaaagcctgactttctttcccttcttctgcttgcggtttccgtttttacgctttttgcggctttagaaaagggaggttttttaaaactcaggaaatcggctctttttttctgcgcggttttggcttatttaatatgccgtccgtatttcagcccatggggagaagcggatatgcttgatatcgggcagggagactcgctgtttataaacgcgccgcaccgcaaagggaccgtaatggttgatacagggggagtgattgcttatcccggagaatcatggaaagaaaaacgccacccgtattctatcggcgagaaggttttgattccgtttttaaacggaaaaggggtgaaaaagctggatgcgctgattttaacccatgcggatcaggatcacatcggggaagccggagtgttaatcaaaaatcatagagtcaaacggttaattgtccccgtgggattcgtaaaagaaccgaaggatcagaacatattaaatatggcgaaagaaaacaacattcccgttgccgaagcaaagcggggcgacaccattacagccggtgatcttcagtttcaggtgctgtctccggagtcgtctgacggaaagagtaaaaatgattcgtcactggtgctttggacggttttaggcggagtgagctggcttttgacgggagatttagaatcggacggcgaaacagaagtgctgaaaacgtatccgaaactgaaggctgatatattgaaggcgggtcatcacggcagcaaaagctcaacgagtgaagcctttttgaaacagcttcagccggaagcagcgctgatttcagcaggaaaagagaatcgataccatcatccgcacgaagaagtgctggatcgtttgaaggcgtactctgtcaatgtgcttcgcaccgatatcagcggaacgattcaatacagatttgaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtcctttttaaagcttcctctttactatttgccgaactcaatttaggatagaaggggatcaagaaagagaggaagtcatacgatcatggtatttgatgtttggaaagccctgaaaaaaggggatgtccgctccgtttattgcttatacggaaaagaaacgtatctgctccaagagactgtcagccggatcagacaagctgtcgttgatgaggagactaaagattttaacctgtctgtttttgatcttgaagaggatccgcttgaccaggccataaccgatgcggaaacgtttccgtttatgggagagaagcggctggttatcgtaaaaaatccgtcttttttaacaggggaaaaaaagaaagaaaaaatagagcataatacaagcgctttggagacttacctgaaggagcctgcgccttatacggtctttgtgattgtggctccgtatgaaaagctggacgaacggaaaaagctgacgaaagcgctgaagcaaaaagcccttatgattgaagctaaggagctgaatgcaaaggagacgactgattttacgattaatctggcgaaatccgaaaataaaacgatggatacagaagctgccgagcatttggttctgcttgcaaacggccatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacaaagtattttgcgggacaaggatacggccaaaagcaaatcgcttccaacttaaaggtgcaccccttccgggtaaagctggcgatggatcaggcgaggctattttctgaagaagagctgcggcgtattatagaaaggctcgcagtaatggattatgaaatgaaaacggggaaaaaggacaagcagctcttgctggagctctttctccttgagcttctccggactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggccacactatgtaccacgatgattgaaggaggtctttcctgtgaaaaacaacgaactggatgtcaatcaatttctgatacggacggatttagcggtagaaacgaaacaggcggtaaaagacggacaagccggtcagacaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggggttcgggaacacgactctgacatgcaggaaaaagtaacggaagtgtttgccgaggaattttccgcctatctgtcggcattaaagattccaaaggatgcaagctgtttgatcgtcggtctcggcaactggaatgtgacgccggatgcgctcggccctctcgtgaccgaaaaccttcttgtgacaaggcatctgttcaggcttcagccggaaaacgtgcaggaagggtacaggccggtcagcgcgcttgctcccggtgtgatgggattaacgggaattgaaacgagcgatattattcaaggtgtgatcaaagaatcaaagccggattttgtgattgcggtagatgctcttgcggcaagagccgttgaaagggtgaacacgaccatccaattttctgatacgggcattcacccgggatcaggcgtcggcaataaaagaaaagaattaagcaaggaaacgctcggcatccccgtcatcgcaatcggggtaccgactgtcgttgatgcggttacgatcgcgagcgatacggtggattatatattaaagcatttcggcagagagatgaaagatgacagcccgtcaagatctctggtgcccgccggaatgaacttcggcaaaaagaaggtgctgacagacgaagaccttcccggagaaaaagaacgccaatcctttctcggtattgtcggcacactggacgaaaacgaaaaacgccagctgattcacgaagtgctctctccgctcggccataatctgatggtcacaccgaaggagattgacacctttattgatgatatggcgaacgtgcttgcaaacgggttaaacaccgcccttcatgaaaaagtgtcacaagataacaaaggttcttataatcattaaaatggttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcgaattctcttcacggaattgccggagaacttccgggtgacgcgtttgcacacctcctcggtatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggactgattatacgaatatgcctgctgaatccccgccgccgtcaaaggtgatggaaaaagaaaaagaagtgaacctggcagaaatcgaaaacaaaacgaaaaaagaagaaaaggcgccgccgaaacattcaacaggcagcaaaaaagtcgtttttatttaccacactcataataccgaatcctatcttcctctgttaaaaggggaaacaaatccggataacgcccgccattcgaaggccaatgtcacgcttgtcggagatatgttcggaaaagcgcttgaagcgcaaggtgtaggagcgaccgtagataaaaccgacattcaggcccgcctgaacaaagacggtttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagggtcgccatcgtcgtcggcaaaaaaagcgctaattttgaagaaaactataaactcgcaagtgaacttcataagctgatggagaaaaaatacccaggcttaagcgtcggtgttttatcaaaaggctctccgggagataatggagtgtacaaccaggatttaaacgatcggtcgcttctgctggaattcgggggcgtggataacaatcttgaagaactgaggcgcgcatcagatgccgtggccgatgtattcagcgaactgtactgggatgcagacaaggtcagctcgcaatcaggagagaagaaaaaacaatagaaatcaggtgatgcaaatgatccgttttaccggcaaatgcctgctgatcgccattgtcatgtttgtcggcgtattgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcagaaaccttcaacctgttttcaaaagccggagaaaccctttcaaataccgtgacggactcggcacaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatattccatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatcttccgagcgcagagccagaacgtgtgcgtcaagaggttgaggacgttatcggccttgacgcttcagacgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaagctctggaaaaacttgaattgaacgattcatctcttcaatacgaggcagagacgtcacaagccctcggcttcggtttccgctgcggctttttaggaatgcttcacatggaaatcattcaagagcggattgaacgggaatttaaaattgaccttattacgaccgcgccgagcgttatttatgacgtttatatgacggacggcgaaaagatcatcgtggataacccgtcaaacatgcctgacccgcagaaaatagagcgggtggaagaaccttatgtcaaagcgacgatgatggtaccgaacgattacgtcggagcggttatggagctttgtcaggggaaacggggcaactttatcgatatgcagtacttagacgccaaccgagtcagcattgtatatgagatgcctcttgcggaaatcgtatatgaattttttgatcagctgaaatccagcacgaaagggtacgcctctttcgattacgagctgatcggctacaaaccgtccaaactcgtcaaaatggacattatgctgaatgcagaaaaaattgatgcgctgtcgtttatcgtgcaccgcgattacgcatacgagcgcgggaaagtcatcgtcgaaaaattgaaagaattgatcccccgccagcaattcgaagtgcccgtgcaggcagcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcggtagaagtgccgcaggaagcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgataagtacttaaactcactcgaaaaggaaatgataaatacaatagaacggacgggacgccctgatctccgcacgattttcatcgggggaggcacgccgacatcgctctcacccgcccagctggaaaaattgatggattccattcaccgcgtgctggagccttctgacggactcgtagaatttgccgcggaagcgaatccggatgatttgtccccggaaaaattaaaaatcatgaaaaatgccggtgtcaatcggctgagcttcggtgttcaaacctttgaaggtgagcttttacaaaaaatcggcagagtgcataaacaaaaggacgtattcacttcctttgaacgtgcgagggctctcggctttgacaacatcagtctcgatttgatgttcggcctgccgggtcagacgctggccgatcttgacaattccgtcaaaacggctttgtctcttgatgcggagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccgtcaatatgaaatcagcaactttgcaaagcccggatacgagtcgcagcataatctgacgtattggagcaatgaagcgtatttcggttttggcgcaggcgctcacgggtatatcagcggcacgcgcaccgtcaacgccgggcctgtgaaacattacattcagctcatcgaagaaaagggactgccttaccgtgacacgcacgaggtgacacgggaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatctgtgacacggaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacaggtattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgttccgatccagccggataaggcggtcgccatcctcgtcacgaacacggggcatgtcgaaaaccgcaccatcaatttcccggctaaagtggatttggccgatattgaaaaactggtcaatatattaaacgatcgattagcgggcgtgccgatggacgaactgaatgagcgcatttttaaagaggttgtcacatatttaaggcagcatatcgccaactatgacagcatacttgaatcgctccgctccacattccatccggcggcccacgttgagaaattgtttttcggcggaaagatcaacatgctgaatcagccggagttccacgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatacagttgatacgaagcagatcggatcaatcgcgattatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggttgaagcagcagaacaagaagaagtgacagaacaggcagaacaagcggcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggctctcgacaactttgaacgggcgttacaggtagaagctgaaagcgagcagacaaaaagcttgctgcaaggtatggaaatggtccgccgccagctgatggacgcacttgaaaaagaaggtgttgaagccatcgaagctgtcggtcaggaatttgatccgaaccttcaccaagccgtcatgcaggtggaggatgaaaacttcggcagcaatattgttatcgaagaactgcaaaaaggctacaaactgaaggatcgcgtcatccgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcgaaacgccaatcaatcacaaatcctaacacaatcatgtctgtcaaacgccatatgggtactgactataaagtggaaatcgaaggaaaagactacacgcctcaagaagtgtcagctattatccttcagcatctgaaagcatacgctgaaagctacctcggcgaaacagtttcaaaagccgttatcacggttcctgcatacttcaacgatgcagagcgccaagcgacaaaagatgccggtaaaatcgccggtcttgaagtagagcgtattatcaacgaaccgactgcagcagcgcttgcatacggacttgataaaacggacgaagaccaaacgattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtatcatctacacaaatttctttaccgtttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggatcaacacgtattcctgccgtacaggaagcaatcaaaaaagaaacgggtaaagaagcgcataaaggcgtaaaccctgatgaagttgtagcgctgggtgcagcgattcaaggcggcgtcatcacgggagacgtaaaagacgttgttcttcttgacgttacaccgctttctctcggtattgaaacaatgggcggcgtgttcacgaaactgatcgaccgcaacacgacaattccgacgagcaagtctcaagtattctcaactgcagctgacaaccaaacggctgttgacattcacgtgcttcaaggtgagcgcccgatgtctgcggacaacaaaacgctcggccgcttccagcttactgatatcccgcctgcaccgcgcggcgtaccgcaaatcgaagtttctttcgatattgacaaaaacggtatcgtaaacgtaagagcgaaagacttaggcacaggaaaagaacaaaacattacaatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaagacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttatgaagaagcggcaaaagcgcagcaggctgaaggcgcagcaaacgctgaaggcaaaaaagcggacgacaacgttgtcgatgcggaatacgaagaagtaaaagacgacgaaacgaaaaaataagttctttcccgcatggctttaggcggaagaacacacagcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatattctcaagcatcttcggaggcggcacgagacgccgtgacccgaatgcgccgcggcaaggcgcggatctgcagtatacaatgaccctgtcatttgaagacgcggctttcggaaaagaaacgatcattgaaattccgcgcgaagagaattgcgaaacatgtaaaggatcgggcgcaaagccgggaacaaagccggatacgtgctcgcactgcggaggttcaggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggtcaaggtgaacctggcgtaaacggagggcctgcgggagatctgtttgtcgtattccatgtgcgcgcccacgagttctttgaacgcgacggagacgatatttattgcgaaatgccgttaacgtttgcccaagcggcactcggagacgaagtggaagtgccgacgcttcacggaaaagtgaaattgaaaatacctgccggcacacaaaccggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgattaacagtttcctcggcgaaacggtggacggcattaaagagacgataaataatctgcttttgtacgacattgatttaggcagaaacacaatcaccatttctgaagttaatgaagaagaatgggcgacagcttggaaaaagtattatcatccggtgaaaatttctgaaaaattcacgatcgtacccacatgggaaacgtacacacccgtgaataccgatgaactgattatcgaaatggatccgggcatggcattcggaacgggaacgcatccgacaaccgttctgtgcattcaggcgcttgagcgtatcgttcaaaaaggcgaccgtgtcattgatgtcggcaccggttcaggaattttaagcatcgcggccgccatgcttgaggccgaatcggttcatgcgtatgaccttgatccggtcgctgttgaaagcgcgcgtctgaatctaaaattgaacaaagtgagtgatacggccgaagtgaagcagaacaatttgttagacggcatcacgggcgaacatgatgtcattgtcgcaaatattctggcggaagtgattctccgctttacatcacaggcgtatgacctgctcaaagacggaggccattttattacttcaggcattatcggccagaaaaaacaggaagtaaaagaagcgttggaaaaagccggctttaccatcacagaaattctgtctatggaagattgggtcagcatcatcgcgaaaaaataacagttagtaggtgtcacagcgtatgcaacgatattttatcgagctcacgaagcaggagatggacgaaactcccgattttcaaattacgggggaagacgtccaccatatagcgaacgtcatgagaatgagtgcgggagaccggataatctgctgttcgaaagacggccatgaagcgttatgcctgctcaaagcggtttctaaagatcatatatcatgcagcattgctgaatggacgggtgaaaaccgtgaactgccgttaaaaatcaggattgccagcggccttccgaaaggcgataagcttgaatggattatccaaaaagggaccgagctgggggctagtatgttcatcccctttcagggcgccagatccgtcgttaagctagacgacaaaaaggcaaagaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgccgcggagcttaaaagccttccgcaaggttcgtctcttttaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaatcattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgtcagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatacgggcggctacggcgaagatatgaaagattataatttcgccaagcttctccgcgagcttgatacacgtgtagaaggactgaagcggatcagaatttcatctattgaagcaagtcaaatcactgatgaagtgattgaagtgctggatgcgtctgataaaatcgtccgccaccttcatatcccgattcagtcaggatcaaacaccgttctgaaacggatgagacgcaaatatacgatggaatttttcgcggaccgtttaaataagctgaaagaagcgctgccgggtcttgccgtcacatctgatgtcatcgtcggtttcccgggtgaaacggaagaagaatttatggaaacataccggttcattaaagaacataagttttcagagcttcacgtattcccttacagcaaacgcaccggaacacctgcggccagaatggaagaccaggttgacgaaaacgtgaaaaacgaacgggtgcataagctgattgcgctgtctgaccagcttgccaaagaatacgcctccgattatgaaggagaggttctggaaatcattccggaagaggcgtttaaagagtctgatgaggacggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccgaaacatgcgcatgtcttcataacagataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaatacctgctgatgcagacaggaagggaaagacgagcagcacgccgagaatattaaacactacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcatgccgataaaaagagcggaccagctcgaatcattcacatggcgcaaaacctccgccccgccttcatttctgtcagcggaacggcaagccggctgaagcatgtgatgcaaaaaaagatgatgccgagaccgaggaagcttataccgatctgcctgaacggatatttacggatgaggataaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggcttttctcaatttttgaatacgttaatgcgatcaggccctgcctgagcaggctcattccgagtaaaaaaaccaggataagtgcggtaaagagaatcagtattatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctgatcgtttagatttagtagataaagttcaaaaagagctggacattttagaaatttatttaccgaagcagctttctgaagaagagctgcagacaattgtaaatgaaaccatcgctgaagtcggtgcgagctccaaagcggacatgggcaaagtgatgagtgctattatgcctaaagtaaaaggtaaagctgacggcagtgtaattaacagacttgtcagcagtcaattatcttaattgacaagaaaaaagacatctttcctagagagatgtctttttttatacataaaaaaatgaaactaaagtacatttgttacgtatataaagaagaacgaaacgggaaggagggtatatttgccttgttccgaaaaaaaaacggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgcgcggatgtgcctgttaccgcttacgttaataaacgggcgctttctgccggagcgtatatagcgcttcaggcagatgaaatctatatggcgccgggcggaaaaatgggtgccgcagccatcatcgacggaaaaggaaacgcggcggacaaaaaggctcaatcactgtggcatgcagaaatggaggacgcagcggttaaaaacaaccgaaatccgaaatacgccctggccatggcagatcccgccatcaatgcaaaggaagcgggcgccccaaagggaaaactgctgacactgacagctgaaaaagccaaggaagtcggatattcggagggcacggtttcagaccttgatgctttatatacaaagctcggttttgacaaagcggatgttcaccatgcaaaagaaggttttgtcggcaaattgggcagatggctgacaaatccgtttgttgtccccgtcttattaacgcttgctttgcttggtttgaccattgaattgttctcgccgggcctcggaataccgggtgccgtcggactgacggccatgctgctgtttttcaccgggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtaatggcggtttctctcttgatcgccattgctgtgtctattacagcctttatcatattaacaagggtgttggggaaacgaatgaaattctttaaaaaattaatattaactgattcaacaagcacggagagcggttatgtttcaaatcagaaccggacggagctgttggggaaagtcggcattaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcaatagttgcagctgccataatcgtgttagccatattcttcacctttgtaccggtgatgctatggatttcggcgcttgcggcaggagtcagaatcagcattttcactttggtcggaatgaggctgcggcgcgtcataccaagccgcgttgtcaatccgttaattaaagcgcacaaagccggcctatccgcaacaacaaatcagctcgaaagccattatctggccggtggtaatgttgacagggtggtcaatgccctgattgcggcacagcgcgccaatattgagctgacatttgaacgctgcgcagccattgacctggccgggcgtgacgtattggaagccgtgcagatgagcgtcaatccgaaggtcattgaaacaccgtttatcgcgggtgtcgccatggacggaattgaagtaaaagcaaaagccagaatcaccgtaagagccaatatcgagcgccttgtcggaggagcgggagaagagacggttgtcgcccgtgtcggagaagggattgtctcgacaatcggttcctcgggtaatcataaaaaagtgcttgaaaaccctgatatgatttcgcagaccgtacttggcaaagggctggattcaggcaccgcctttgaaattctttcgattgacatcgccgacgttgatatcggcaaaaacatcggagcgattcttcaaacggatcaagcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgctgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacggccgccgggtacacgccccgaaaatcagacaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggcttgaacataagctgacatctcaacgcgcacgaaacgcgtctctgaagaaatcagccctcaaaataaataaagaaactgcggttcaaggcattatattcagtgaggttttgggtccgccccgtgcaaaaaaaccgcaccggaccatgcggagcatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcggattacgatggtcggcagacttcatatctacatagagaatcacagaggcctcctgctgttcagcgaagaagaagtcaggctgatgctcaagcaggggcaatgtatcatatcaggaaaaaacttggtcattaaggcaatccttcctgaagaaattcttttggaaggcacgatagatcacgtacgatatgtcgattcataaagccggggggaaataatgtgaaaaacaaatggctgtcatttttttcgggtaaagtccaaatggaagtcaaaggaaaagggattgaacggttgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaacctgggcttcactgcgggatttgtgatgtttttcgttatattgtttcttttgtccaacatgatttgggacattgatattaaaggggccaagcccgaaaccgagcatcagatggtaaagcaccttgaagaaatcggtgtgaaaaaaggacgtttgcaatttttaatgatgacgccggagaaaattcaaaaatcattaacaaacggcattgataatattacgtgggtcggtgtggaattgaacgggacagcccttcatatgaaagtggtcgaaaaaaacgaaccgacaaaagaaaagtacgtgagcccccgccatatcgttgccaaaaagaaggcggtcatcaaaaggatgttcgtgcaaaaggggcagccgatggcttttgtgaacgatcatgttgacaaaggacagcttctcgtctcaggactgatcggaaatgaagatcggaaagtcgcctcaaaagcggaaatttacggagaaacatggtacaagtcagaagtaaccgtgcctcttgaaacatcatttacgctatatacgggtaaagtaaggacgaagcacaagctgtctttcggatcatggggcgtgcctttttggggctttgaatttaatgaggagccgctgaaacatccgaaaacagaggaagaaaagcacccgtttcaatttctggggatgaagcttccgatttcttacgttcaagaacagacaagagaaagtgaaacaaccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcctttttacatttaatggagaaggatctgggcattagcctcatcacgcgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccctcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggctttctgcccggagatttaaaggaaaaagtagatccttatctgcgcccgctgtatgacgcgctccatgatgtgctcggaagcgaccatacggagcgtcttatggaaagaggggttattgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggatatgctgaaggacataaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaaggaaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgttttcagtcagtgataagacgatttacgcgcccgccacagtggaagatcagcaggcgacggaatcgaaaaaacaggcggccgaagatgcggtggaagatcaatacaccctgaaaaaaggctataccgacaaccggcttgacctgatcacttccatttttgacagcatcggcgaagtgaaaaaagatgcggaaaaagacaaaaagtcaccttcggaaaaatcattggtcaaatcggtgaaaaacaagctgacacaggatgtcaatgaatccgtctcggaagatgccattaaatcgcttctccatgcaaacaatgaagatttctcatttgtgagggattccgtcattaccgcggtgaatacggtgatgagcagtgaaattccttctgaaaagcttgccgaagcgaaggataaggtcgcaaaagagctgaaaagcgcttctgtgccgtcaaaatatttagcggctgcgactgaaatcggaaaatacgcggtcattccgaattacgtatttgatccgaaagcgacggatgaaaaacgccaggaagcgtcagacagcgtccagccggtacagatcaaacagggacaggttctcgtggaagagaatgacctgatcgaccgggaagtatacaggaagcttgaactgacggggcttttgaataattccaacctgttaaagccgatcagcggtctgcttctgatgatcgggctgtttatcgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttgggaagcatcattctggcgatctgcggcagtatgatgtttaatcagggtgtgacgggaacatttaattacgtcatcggcatttactatttaatcagcagcatttcaggcattctgtttttggggaaacacaatgcgagatcaaaaatattgcaggcgggactgttcgtctcatttattaatatgattatcgtgctgtcgcttttattaatacaaaatacggcgctgtcacctgttgaaatcggaacgctgatgctgatgggggtcgtctcgggacttgcttcatccgttttgattatcggtctgatgccgttttttgagacgggattcggcattctttcaacgatgaggctgattgaactgtctaatccgaatcatcccctgcttcgaaagattttaacggaaacacccggtacatatcatcacagcgtcatggtggcaaatctgtcggaagcggcttgtgaagccgtaggggcaaacggtcttttagcacgggtcggagcatattatcacgatctcggcaaaacgaaacgtccgcaatattttattgaaaatcagatgaatatggataatccgcatgacaagctgtctcctcagctcagtaaaaatatcattatcgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgccaaaacactatgtgcgactttaaaaggaattttccactcccggattgaatatccggaggctacgaagaaggtgaaataaatgggtttactcatagatattgttgatgaaacgaacagcgtctcagctgatgcgctccaagaagtggagaagctgctccaattcgcggcggaaaaagaaggcgttcaggatcaggctgaagtatcggtcacgattgtgacaaatgaagaaatcagagaaatcaacagagactaccggggaaaagacactccgactgacgtcatttcgtttgcgcttgaagaagaaggcgaagacgaggtggaaatcgtaggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttactgatcagtatcacccgctcgcaaaagcggcaaaggacgcggccgccggagccgtttgcgtctttgccgtgatatcgtgtatcattggtttactcatcttcctgccgaagatatgttagcagaagattcttacaattattttacattgccaaaaatgggcgtgaaaaaccgatcataattatgtaaaataaaagtgacagcggtatcatacaggataaaggtaagagaggaattaagtacacatgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgaggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaaatcaggatttgtatctatcatcggaagaccgaacgtaggaaagtctacctttttaaacagggtcatcggtcaaaagatcgccatcatgagcgacaaaccccagacgacaagaaataaagtccaaggggtgctgacaaccggcacgtcgcagactatttttattgatacaccgggcattcacaaaccgaagcacaagcttggcgactttatgatgaaagtggcgcagaatacgctgaaagaagttgacttggtgttatttatgatcaacgccgaagaagggtacggaaagggcgacgagtttatcattgaaaagctcggacagacgtccacgccggtctttctgatcgtaaacaaaattgataagatccaccctgaccagctgcttcttttaattgatgagtaccgtgcgcgctatccgtttaaagaaatcgtgccgatctcagctttggaagggaacaacgtcgaaacccttctcgcgcaggttgaagcgtatttaccggaagggcctcaattctatccgagcgatcaggtgactgaccatcccgagcggttcattatttctgaactgatcagggaaaaggtgctccatctgacaagggaagaagtgccgcacagcatcgctgtcgctatcgagtccattaaagggcaggaaaacggctccgtccatgtcgccgccaccattgtagttgagcgggattctcaaaaaggcatcgtcatcgggaaaaaaggagcgcttctgaaagaagtcggcaaaagagcgcgggctgatattgaagcgctgctgggttcacgcgtttacctcgaattatgggtgaaagtgcagaaggactggcggaataaaatgtctcagctgcgtgatttcggcttcaaagaggatgaatattaattcatctaaagcgcatgcctgatgtgtgggattacctcacagaaacagggcttcgttagcaaaatttgtttaacatgaaaaggaggacatcaggtcaagataagggtaagaatttggattggcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccgttgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcacattcatcgtgcagatgaaaatgctcggcgtcatggggctgtatccggagctgaatcattgtgtccactgcaaaagcggggaagggacgtttcatttttcgataagagataacggttttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacaggtcattgatctgtattacgaggaatattcaggactttatttaaagtcaaaacggtttttagaccagatggaaagcatgaagaaccttttggatgaaaacaaaagttgacattctgcccatctttttatatgatcatttattataaaatatgttgcagtgacagaaagaagtacttgcgtccaactcatacaagcgaccttaggacagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggagccgtggagagtggcttacgttgagccgtccagacggcctgcggacggacggtacggtgaaaacccgaacaggctctatcagcatcaccaattccaagtcattattaagccgtcgcctgataacattcaagagctttaccttgattcattgcgtgcgctcggcattgacccgcttgaacatgatatccgtttcgtagaagacaactgggaaaacccgtctttaggctgtgcaggtctcggctgggaagtatggcttgacgggatggaaattactcagtttacatatttccagcaggtgggcggaattgaatgtaagccggtgtccgttgagatcacatatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggcttgtgcatccggcctatgattatgtgctgaaatgctctcacacatttaatctgcttgatgcaaaaggcgcgatctcggtgacagagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccggctggcttgctgaaaaaaatatcgcccacggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgacctgtatataaaagatgtaaacggcacggaatatgtcttcgttcaaaaattccaggcgggacaagagacgaagacacttttaccgcaactggaaaatttgattgccggaatgcattttccgaaaaacatgcgctggggcacgcaggatctgcgctatatccgtccgatcaaatggattgccgccctctttggaaaagacgtcattccgtttgaaatcacaaatgtcaagacgggccggaacacgcagggacaccgctttctcggccaagaagtatctgttgatgcgccgtcatcatacgaaaagctgctgaaagaacaaagcgtcattgctgacccgaaagaacgcaaacaaatgatccaaagccagctggatgcgcttgcggccaagaagaaatggaacattccggtcgatgaggatctgctgaacgaagtcaaccatctggtggaatatccgacggcgctttacggatcttttgaatccgagtttctttctatccctgaagaagtgcttgtgacaacaatgaaagagcatcagcgctacttcccggtaaaagatgaaaacgggaatttgcttcctcattttattacggtgcgaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaattggaaaatatcgttttccatgaagagctcggctcccttggagataaagtaagaagagcggtcaccattgcgggcaaacttgccgtccgcctgaaagcggatgaacagacgcaaaaacttgtgaagcgcgccgcagagatttctaaatttgacctggttacacatatgatctatgagttccctgagcttcaaggcgtgatgggagaaaaatatgcgcgcatgctcggtgaagatgatgccgtcgctgccgctgtcaatgagcactatatgccgagagcggccgggggagaagtgccttcaacctttatcggcgcggtcgtggcgttagctgataaactggacacgattgcttccttcttcagcattgacgtaattccgacaggttctcaggatccgtacggattgcgccgtcaggcaagcggcattgtttccattctgatcgaccgcaactggggcatttcttttaaagaactgctgtcgttgacagaaacggaaaaagagaatgagctccttgatttctttacacagcgtctgaaatacgtattaaacgctgaagacatccgtcatgacgttattgatgccgttctggacagcacagagcttgagccgtatgcagccgttcataaggcaagagtgcttgagaagcacctcggcacacccggctttaaagaaacggctgaatcactcggccgggttatctccatcagtaaaaaaggcgagagccgcgatatcaagccggatctgtttgaaaatgaacaggagaaaaagctgtttgacgcttatgaaaaaacaaaagacagtgtcgcggaaagctttgcctccaaaaactatgaacaggcgcttgccgtgctcagcggattaaaagagccgatcgaagattactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgaaaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgatgattatgtgatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacgggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtttgaccgccaaatatgaaccgggccgcgtccggcagcttgatgaagattatttcaaaaaggtcgaggcgatcgagtttgccgtcaaatatgacgatggcagggatccaagaggcattttaaaagccgatatcatcctgctcggagtatccagaacgtctaaaaccccattatcacaatatcttgcccataagcgtctgaaagtggccaatgtgccgatcgttcctgaggtcgacccgccggaagaactgttcagcgttgatccgaaaaaatgcatcggcttaaaaatcagccctgataaactgaaccatatacgtaaagaacggttaaaatctctcggcttaaatgacaaagccatttacgccaatatcaacagaattaaagaagagctggagtattttgagaaaatcgtggaccggatcggctgccaagtcgttgacgtttcgaataaagcagtcgaagaaacagcgaacatcattcatcatctcaaaacaaagggccgataactcaggacgctttatcctgggtttttgggtatgcaaatagggaataaacaaaaaggatggcatcttcgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaattcagcgttcgggttattttcgtcgcatcatttgaacactaccagctttccagaagcaaagacgagaactgggtatacgttgatcctcataaagaagcggcagatttatatatcgcaaaccatgtgagatcgggagacgtcgtagtcacgcaggatatcggtttagcatctcttttgctgaacagaaatattgccgtcttatcggaaaggggccgttcttatactgaagacacgattgacttcgctctgatgagccgtcatatgtcaggcaaaatgagaagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggagcgggcgggaacgttttctctttcttacggcagatggaaggctattcatttacggaagctgtttctcaccttgcggataaatatcagattgatttccctgatgatataacgattcactctgcatccaggcctgaatcttccggagagcagaagatggaggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaaatgatggaaaaagcgggtctgctgatcagaagagaagacggcagcgggtattttgaccgtttcagaaacagaattatgtttcccattcatgatcaccacggagccgtggcggctttttcaggaagggcgctcggaagccagcagccgaagtatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagagcatgtgaaaatcctcagaagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcaatatttccgcaaagggaaaaacttatctgacgaaggagaccggctcgcttatatgaaagaagtgctgaaagaaatcagcgctctttccgggtcgcttgagcaggaaatgtatgtgaagcagctcgcctcagaattttctctttcggtagaatctttgacggaacagctttccatctacgccagacaaaacgcccccggcgacaaaaacgccgaaccgcagacaagacgggcccgggtgacgactaaagcgaaacggcgccgtctccgtcccgcctatgagaacgcggaaagacttctgctcgctcatatgctgagagaccgaaacgtcatcaagaaagtgattgagcgtgtcggctttgaatttaacattgacggacatcgtgcgctggcagcatacctgtacgctgtttatgaagagggtgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcggatgcggagaggcagaaagacttcgtgaaagctgcgtctctggctcaagaaattgttgcattgaaccgatcattaaagtaacaacaaatagaggcttgcgttctgattggcaatgattccttgcggaggagcaaatagatcgcttaacctcatcatgaattgtcattattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcacatggtggaaaccattaataaattaatccgggtgcagcgtcagcttcttcaggatcttggcagagagccgacaccggaagagattgctgaagacatggatcttacgcctgaaaaagtccgtgaaatattaaaaattgctcaagagccagtttctttagaaacaccgatcggtgaagaagacgactcacatctcggtgattttatcgaagaccaggaagcgacatctccgtcggatcatgcggcatatgagcttttaaaagaacagctggaagatgtgctggatacgttgacagatcgtgaagaaaacgtgctgcgtctccgtttcggtctggatgacggacgcacaagaactttggaagaagtcggcaaagtgtttggagtaacgagagagcgtattcgccaaattgaagcaaaagcgcttcgcaaattgagacatccgagcagaagcaagcgtctgaaggattttctcgaatagaatggaacgggtctttttgatccgttcttttttatgtataagatatatggataatatacctttattttactggataagcatatgttttgcaaatgagtttggaaaaaatgcggcatgtcctgaaaggggggaaatgagacaagtttatttatattctttattgtaagcgtatacaattcattatacaatagaataaagataattttgtggtaagcaaaacagttatttttgctttttgtataaattgtgaaatcattgaaattgctgagcaagaccatttactttttgtaaaaataagttagaattagaagtgtttacataggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagccaactgcatcacctgtcacggagaaaactatgaaggtgtgtcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatcgaaaagattgcagtctgtggcggaatatatccctccgggtgccctggttgctgatatcgggtcagaccacgcgtatcttccttgctatgccgttttgaatcatttggcaagccgggcaatcgccggtgaaattacagacggaccgtttctatccgccaaacagcaggtggaaaaactgcacttaagcactcttatctccgtaaggaaaggtgacgggctgagcgtccttgaaaaaggagaagccggcgccattacgatcgctggcatgggcggagcgctgatcgctcatattttggagtcgggaaaaacgaaattgacagggcgtgaacggctgattctgcagccgaatattcatgccgttcatataagagagtggctgtatcaggaaggctatgaactgcttgatgaagtgattctcgaagaagacggaaagtgttatgaaatcctcgttgcggaaactggcgaccgtgatgcgccttatcgggatgtgccgatggctgtcggaatgcttgcgggtccgtttttgttaaaagagaggaatgaagtgtttcttcggaaatggagccaggaacttaagcatactgaacaaatttatgaacagatcagccgcagcgcaaagcatgaaaatcatgaaaaattagctgaattgaaagagcggatttctctgctgaaggaggtaatcggacatgcctaaacatgtgaacggacaggaaatcatccagctgtttgaacaattttcaccgaaggcttatgcggtggaaggagataaaatcggactgcagatcggtacattgaataagccggtgaaaaatgtcatggtgacactggatgttttggaacaaacggtagatgaagccattgagaaaaaagttgacttaattatcgcccaccatccgccgatttttcggccgcttaaacagatcaccactgatcagccgggcggaagactgattgagaaatgtataaagcatgatattgccgtatatgcggctcatacgaatcttgatgtagcggacggcggtgttaacgatctgcttgccgaagctctcggcctgacagacactgaagtgctcgtcccgacatattcggacccgatgaaaaaacttgccgtatatgttccgaaagactatgaagaagctgtaagaaccgcactcggcaacgccggagcgggacatatcggcaattacagccattgcgcgttctcttctgagggaatcgggagctttaagccgctggacggggcagacccgtttatcggacagacgggagagctggaactcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggcctcggccggatcggaaaacttcagcaggacatgacgcttgaagagtttgctctgtttgtgaaagaaaagtttgacgttaacggagtccggatggtcggagagcgaaacagcaaggtgaaaaaggtcgcggttcttggcggcgacggaaataaatatatttatcaggcaaagcggaaaggtgcagatgtttacgtgacgggcgacctttattttcatgtagcgcatgatgcgatgatgatgggattaaacgtcgtggacccggggcattatgctgaaaagatcatgagaaaaggcacggctgagaagcttacggcaatggccggagagaaaaactatgacgtgcgcattttcgcttccgaaacagatacaaacccatttaccttcttataaaaaaactgaggccccgggcctcagttttttatttttactttcggaagaatttttttgagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgagccagcctgttggagttattgcttttcggatcgccgacaacaatggttaagtccgctttttttgcctgctctgatacagcttcttgacgaacctgtgtggccaggcagatttcctgatggtattccacgtgcgggtacttttctttgactgattccataatatcgtggacgtcccactgggacattgtcgtttggtttgtaacgattaatttctcagcctgaatatcgagatttctgacgtcttcttctgtttcaacgagatgaacgatttcaggagcgacgccgacggctccttcaggctcggggtggccttttttgccgatgtatatgacatgatagccttcagcttttacttttcggattaagtcatgtgttttcgtgacgtccgggcatgtggcatcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgtgttggatgaggcgtctgatttgttttcatcttctgtttcatctgttttttcagcttcatcctttttatcctgttcgtttgtttcttttgtctcgtcagattcattctcatcatcgctgctgcttaattggctgtaaagcttcatcatggcgggcagactccgtactaaaggaccgtactgctgaatcatcggtgtaacctgctgcgccacgccgagcaccttctgaacgttgccgagcatgctcgacagggatgccggacttgccaggttctgtattccctgcagtcctgcacctgctcctccgctggccgccgccggtgccgacgcggcagcgcttcctcctcctgaaccgggtaaaaaacgggaaagcatcccttttaagccccctccgccgcccgtgcctgcgtttctcaggcccgctccggcaatctgctgctgagggaaaagctgccggccctgctgcatcagctgccggcccggcaatgacggtcttcctcccatcatcatacgcggattcatcaacggccggccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcggctgatacccgccgtgctgaaaaacgaaagcgtgatcgggcagtcccagacggggacggggaaaacccacgcctatttattgccaattttgaatcggattgatccgggttctgatacggtgcaggctgttatcacggcgccgacgagagagcttgccaatcagattcatcaggaagcgctcaaaatcacacagggtgcggaagatgagccgatccggacaaaatgtttcatcggagggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagcagatctgatgcttgacatgggctttttagaagatgttgattatatcggatcgcggatgccggaagaacttcagatgcttgtgttctcagctacgattccggaaaagctgaagccgtttttgaaaaagtatatggaaaatccgaagtacgcgcatgttgagccgaaaagaatcacagccgaaaagattgaacatgttttggttccttctaaacagcgtgataaagacaagctgctttttgatatgatgtctcatctgaatccttatctgggcattgtgtttgccaatacgaaaaacacggctgaccatattgcgaaatacctgactgaaaagggcatgaggatcggtcttctgcatgggggattaacgccgcgtgagcgtaagaaggtaatgaagcagattaatgatctggaattcacttatgtcattgcgacagaccttgcggcaagaggaattgacattaaaggcgtaagccatgtcatcaactatgagcttccggacgatctggatttttatgttcaccgcgtcgggagaaccgcacgcgccggttcatcaggccaagcactgaccatttatgagctttctgacgaagatgcgctcgtaagactcgaaaagatgggtattgtgtttgactatgcggagcttgtaaacggcgaatggaagaaaggcgatgaccgccaccgccgcaaaaaacgcaaaaaatcggagaatgaggccgaccaaatggcgaagcgcctcgtgaaaaaaccgaaaaaagtgaagccgggctataaaaagaaaatgagctacgaaatggaaaagataaaaagaaagcagagaagaaacaaatctaacaaaggaaagtaggggactcgggttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataaaaaaggagggggaattgccccctccttttttaccctgagaattggttgaaaagttcgtcaactttccgagctgtttcttttgaggttatcgtttctacttttttcagcaggcgaagccgctcctgttcatcaaaaatattgatgttttttccgtgcatcagagccgctacctcagccgcttgacttctcgtaatgctgattccgtattgcttggaatatttcagaagatcgtccgcagtgacttgattgagccgctgcaaaataattctttgtattaaaatcatcgatactttcacctctttagacataatgtattgagcaaatcattaaaatgttacggcttttaatggtaaaatgaagttgcttactgtttaaaatagttattacaggaaaggagattttatgaccccaaataaacagcataaaagagagtcatttttacactttatcttcagggtcattatgattctgatcggggcgggttcagccgctgtaagtattgaattgtttctggtccctaataattttatcgacggaggcattatcggtgtttcattaattttagaccacctctttatgtccaatcccctcctcaatttcgccttattcgttgtgttactcaacattccatttatgattttcggatataaatatatcggaaaaacatttctcatctctactgttatcggaattgtcggtttagcgctgattgaatcctccttgcaccatgtggaggccattacgacccagcctattttggcgacggtattcggcgggcttttgctcggtttcggggtaggccttgtcatccgaaacggaggctcgatggacggtactgaaatactcggtatccttctcacaaaaaagctgcccttctcagtcggagaattcgttatgctcatcaatgtgtttatttttatttgggccggttttgtgttcggtccggagcaggcgatgtattctttcatgacttattatattgccatgaaaacgattgacgccgtcatccaggggcttgatgaaacaaaagcggtcattattgtggcagatcagtatgcggaaatttcagacgcaatcttgcatcggcttggaaggggaaccaccaagcttcagggaaaaggcggatatacggatgaatccaaagaagtcatttacgcggtcgtgacaaggcttgaagtgactaaattgaaatccattgtgtttgaaattgataaaaacgcctttattacgatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggtctgagttttgataccatataccgaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgctatatacaggaggtttttttcagcttttaacatgctgaaagctgtgtttgtttttattaatccaggcgacggcttcaagccaattatgcaccctgataatattggaatcgatggggagctgattatatggggagttaaaaaggataaccggaatgcctgcttcttttgcgatcattgtcgcgttgccgtggtgatcttcgaaaaataaatcaatgccgtgttttttgacggcttccactttgtgatggcctccgacaagctcaatgtgatcgtaatgaatgtcccggtttgcaaaccagtccagcgtaacatcttctaagtggccgcgtcttgccgtaatgtagataagacggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaatccgtaaaaaacgcggaaactaaaaaagctcctttcataaaagaaaaagggggaattgaaggtggcatacgattacgaaaatcgaaaaggcaacgactattacgtggatcatggatcggaaggaaccgatatcacgcgtgatgtttattcagaagaaacagcggccgaaatctcagagccatatcgtgcttctgaccgggcagcagaccgtgatgataatcgggacggagtaagtgaaggccggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgcttggcatcttcattacaccgtttttttaacacaacgcaaaaaaaaagcttggcggaatatccgtcaagctttttgtgtttcttgttctgcttttgctttttctgcttcaagctttgcatagtgttcttctgccagcttgtcgatttcttttttgagctcttcgaccattgtttcttcagggactttgcggacgatttggcctttgcggaaaagaagtccttcgccgcgtgcgccggcaatcccgatatcagcttctcttgcttcgcccggtccgttaacggcacatccgagaaccgctactttaatcggcgctttgactttagaaatgtattcttccacttcatttgcgatgctgatgagatcaatttcgatccgtccgcatgtcgggcatgaaataagcgtagccgcgtttgaagcaagaccgaatgatttcagcagttctctggctacttttacttcttcaacaggatcggcgctcagagagatccggagcgtgttaccgattcctttgcttaaaatcgctccgagtccggccgcgctttttaccgttccggcaaacagcgtgcccgattctgtaattccgaggtgaagcggataatcaaatgcttttgacgctttttcgtatgcttctatggcgagattgacgtcagacgctttcatactgacgatgatgtcatgaaagtcaaggtcttccaggattttgatatgatgaagcgcactctcaaccattccgtcagcagtcggatagccgtatttttctaaaatgcgcttttccaaagatcccgcgtttacgccgatccggatcggaattcctttttctttcgccgcttttacgacggcttccactttttcgcgacggccgatgtttcccggattgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaatggcgtttgcttttacattcggattcagcgcttcaaaatcttgtgcaatatcatctggcgctttatgtgcgccgactatcgacatcaccgtatcgccttttttgaccgtaaccgttctgtatgaagcttcctgttgggctggctgtgccgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttatacatctgttttacttcgcggtatctcttttaagacgaggaaaaggatgataaagtttacaaaccaattcactaaaaattcactcggcaccgtaataacaagcgcgcgcatgatcgtaaagaatacggtcgaaagtgtaatggaataagccgaaagcttccagagctgctggtaattcaatgtctttctttgcgcatttttcaatatcaggccgatgacggcgagaaatgatacttcaatgaatttgcctgccgctgtcatgatgaacagcaaaacggacaggacggtgacgatcattgttttattttggtttaatgctgatatgatttctttttttgtgatatcggcaggcatcagcgaataattcatttctgtcgcttgtccgtctacagcaagcaccattttatttttcaaaatgccgatcgcattttgtttcgccgctatttgtttcgcgccgtaagcatctgtgggatcaaagacgatgacgaacccgttcgcttccgtttccttagaggcggacgctttcgtctgcaattctccgtttgaaatgctgaaatcagggaaatctttctttaacacggttttgaaaccgttcattgagtttacggtgccggagcaaaggtaataagcgcttggcagcgtaaaaaggacagacagcaaaaatacataaaggatcgcttttcctatcccctgaaaccgtgtttttgcaatatctgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacataataagataaagcgggaagcggtgatcgcccgcaaaacaaaggagggtgtttttgtcatgagtgttttgtattggctgattatcattgcggtcttcatcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgattatgtgtcaaatttacttggcgttaaaaggtacggaggaagcagggcggcaatctggggaagcacgatcggattattgatcgggcccttcgttattcccgtggcaggcattatattagggccgtttatcggtgctgtctgcgctgaggtgtttgttcatcaaaaggatatcaagtccgcggcaaaagtggggctcggctcgttaatcggttttttaacaagcgtggcggcaaaaggcgtcattcagctctttatgatcggatatttcttatggacggtgctttagaaaggtttaatttcggcagggaacggataaagtgtaatatgtctgctggaatcgccggattgtgagctttttcattgattaccatgctttcttttgttacattgagattagaaaagttcgcgttaagcggcatttcagtacatatatttaaaggaggaaaaaaattatggcttacaaacttccagaattgccttacgcttatgatgctttagaacctcatatcgataaggaaacgatgacgattcatcatacgaagcaccataacacatacgtgacaaacctcaacaaagcgatcgaaggatcagcgcttgcagagaaatctgtagatgagcttgttgctgatttgaacgcagtgccggaggacatccgcacagctgtccgcaacaatggcggcggacatgccaaccactctttattctggactcttttatctccgaacggcggaggcgaaccgactggtgagcttgctgaagagatcaaaaacacgttcggaagcttcgatcaatttaaagaaaaattcgccgcagcagctgccggccgtttcggttcaggctgggcttggcttgttgtaaacaacggcaaacttgaaattacaagcacgccaaaccaagattcaccgctttcagagggtaaaacacctgtcctcggtcttgatgtttgggagcatgcgtactacctgaactaccaaaaccgccgtcctgattacatttcagctttctggaatgttgtgaactgggatgaagttgcccgtctttacagcgaagcaaaataaatagttcgatcaaacaaggtctcccgcgggaggccttgtttttttattgactttgaatccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggccggccggctggctaaaaaaattgacagggtgtttattctcaggttcggcgttatctttttggccgctttttatttaagtgtgctgcttgctggagaaactgcggcttcccgtctcgttttgataggggccgtgctcggagttggatacggcttttactggctggcttttaatgtgctgacgttcgaaattacggaaccggaaacgagagatttttttaacgggtttttaggcattttgtcttcatcggcgggcatgatcggtccgattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtttttgtattcattgcgacaaacagtgagctggcgctcggaacattcggtctcgtcaattccgcggtttctttttttgcctattattttgcatcaaggctcatcaaaaaaagagctcggaaaaaggcgattcttatcggcggattgatcttgtacggtgccctgtttcttatcatttttaaaatgagcttcacgacgctccttttgtacggagtgtttattgcgatcggctatccagttctgctcgtgccgtatgtctcgcttacatatgatgtgataggccgggcgcggcttgccagaaaagccagaattgaatacattgtgctcagggagttatttttaaatgcgggcaggatcgtttccatcctttgtttccttgtaatcgttacattattcaaggaaaaagtgggaataccggcggcgctcgtgctgctcggagccggccatccgctgatttattactttataaaagacatcagactggatacggaaacttctgatgaaacagtagaagaagaccgacaaaaacaggcggcggaaccgaattttataaaaggagaaagataaaagggttatctgtagaaaaatatcgaaaaaacctttagaatgaaaaatgacacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggccgcgtttcttattttcacttggattatcgtcgagcttggcatcaagcagatcgttcagggtgatgattataaaaacgccgctaataagcaggaggagtctgatgtcagcacggcggttccgagagggaaaatatacgaccggaacctaaatcccatcgtaacgaataaagcattaaatgcgattacatatacacgttcagcctcaaccacccaggcgcagcgtttaaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgaagatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttagatgaactgccgggagttgacgtgacgtctgactgggaacggtcttatccttataaaagcctgatccggacattgctcggcagtgtatccagtgcgaacgaaggtcttccttccaatctgctggatcactatctgtcactcggctacagccggaatgacagggtcggaaaaagctatttagaatatcaatatgaaagcctgctgcagggtcaaaaagagaaagtgcagaacttaaccgactcatccggaaatgtcacgggcagcaaagtgatttcaaaaggacaggccggcaaagaccttgtattatccattgatatggacctgcagaaatccgttgaaaaaatcattgagaaaaatttaagatcggcaaaagcgagaccgagcacgaagcttcttgatcgggccttcgtcgtcatgatgaacccgaaaaacggagaagtgctgacgatggccggcaaacagattacgaatgatcatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggaccaatttaggtcccgtagatatccaaaaagcgcttcaggaatcctcaaacgtgttcatgttcaaaacggcgattgctgtcggtaaaggggagtacaaaaaaggccagtcccttccgcttgatatgaaggcattcgatactttcagatactacttcaatcagttcggactcggagttaagactgggattgatcttccgaatgaagcaaccgggtaccaagggacacagcgaatttccggtcttctgttagactttgccatcgggcagtatgatacgtttacaccgctgcaaatggcgcagtatgtatcaacgatcgccaatggaggctatcgtttgaaacctcagcttgtaaaagaggtcagacagcctgattcgaaaaaaggaatcggagccgttgtagagtctgttcagccccaagtactgaacaagattgatatgaatcatgcagacattaaagaagtgcaggcaggtttcagacgtgtcatgacaaaagggacagccgcaactgattttgcgacggcgacatacagtcctgccggtaaaacgggtacggcgcaatctttctatgacggtcctgacaaatcagagacgggtgaaggaacgtataatacgactcttgtcgcgtatgcacctgctgataatccggaagtggctatttctgtagtcgttccttgggcctatattaattacagcgatcgatattcgattacgaatgatataggaagagcagctctggacaaatactttgagctgaaaaagaaacaagaagataataatacgaagcagaaaaacgaagataaaattcaggaagacgctgaaaacggcaatacaagcaactaacagaaaaacgctcacaacctgtgagcgttttttttatacaaaaaaacatccggatttacaaaaccttaacacttgatttatacgcattttacaagaaccctttactctatacgtgtaggacaaattacacattaaatgcagggggaattcaggaaatgaaaaaaaacaaatggatgcttatgcttctgatggctgctgttatgattgttgctgcagcatgcggaaatgcaaaggaaagcggcaagacagacagtcaatctgcaagtgaggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggactttcgcaagtgtctgaaggggcagtgcaaatcggcaactcagatgtcttcgctgaagaaaaagaaggcattgatgcgaaagccctaaaagaccaccgagtagcggtagtggcgatggcggctgcggtcaaccccggtgcgggcgtaaaggatataaccaaaaaacagctgacagacgtctttacaggtaaaattaaaaactggaaagagcttggcggtaaagatcaaaaaattacactcgtgaaccgtcctgattcatctggaacacgcgctacgttcgtcaaatatgctcttgacggagcagagcctgcagagggcattacagaggattcctccaatacagtcaaaaaaatcattgcggaaacgccgggagcaatcggttatctggcattctcttatataaacgatgacaaagtaacgcctttatcgatcggaggcatcaaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcagggctacattccgatctctgatatgaaagtcacacgtgacgcaaacggcaagcaaagctgaggggagggcgggctccccgcctcttcttctttataggagtgtaaacaaatgataaatcacagagaaaaagagtctgtaagcgaacgcttaataagctcaaaacaaaacaggcaattggatgaagtccgcggaagggtgattgtgtctgtgtgtgccgcgattatcattgcggcatcagcggcgatcacaatttttctcggcataaaggggctgcaatctttttttgtaaatggtgtaagcccgattgagttcttaacaagtctgaattggaatccaacccaggcaaaacctgagttcggcgcgctgccttttattttcggatcatttgcggtcacgattctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggggcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattatcacgttaaacatgggccataccacatacggcagtattgaaaataatacgttatggtctatggggcttgttcttctcatcatgtcgtttctgtttatattgctcatacgctacttgtcatctaggaggaaagtgtaatgaaccggaaaataacggataaattggccaccggtgtattcgggttatgcgccgctgtaatcgcggcgattttggcaggattgtttttgtacattcttattcacggcgtctctgaaatctccttgcgttttcttacgtcaaaatcgagcgccattgcctcaggcggcggaatacgggatcagctttttaactccttttacattctgtttatcaccatgctgatcacgataccgcttggtgtggggggcggcgtctttatggctgaatatgcgccccaaaataaaatcaccgattttatcagaacgtgtattgaggtgctgtcttcgcttccgtccattgtcatcgggatgttcggcatgctgatgtttgtaaacctgaccggatggggctacacgattatcgggggcgcgctcgcattaacggtctttaaccttcccgttatggtccgggtgacagaaggcgcgctcactgcagtccctaaggagctgaaagaagcttctctcgctttaggcgtatcgagatggcataccgtcaaaacggtgctgattccgagtgcgattccttcaattttaaccggagccattctggcatcaggaagagtattcggagaagcggccgcattgttatttacagcggggctgacaacgccgcggctgaactttacggatttgaacccattttctgaatcatctcctttcaacattttcaggccggctgagacgctggcggttcatatatggagtgtcaatacgcagggaatcatccctgacgccgaagcgattgcaaacggcggctcggcggtgctggtgatttcggttctcttgtttaacctttctgcgagatggctcgggtctgtcatttataaaaagcttacggcaaattaatcggaaagaggcgaaaacatgatcgatcacatcatcagggaacaagcggaacagacaaagcgtttgccggagtcttcgattttggaagtgaagcatttatcaatttattacggtgacaaacaagcggtaaaagatgtaaacatgaatattgaaaaacatgcggtgacggctctgatcggtccgtcaggctgcgggaaatcaacatttttgagacagattaacagaatgaacgatgccattgcttcggcaagaagcgagggagagatcctttatgaagggctgaatattttgggtgaagcgattaatgtcgtgtctctcagacgggaaatcggtatggtgtttcaaaaaccgaatccgttcccgaaatccatttacaataacatcacacatgcgctgaagtatgcgggggaacgcaggaaagccgttttggatgaggcggtcgaggaaagcttaacgaaggcggcgctttgggatgaagtcaaagaccggcttcattcatcggctctgtcgttatcaggcggccagcagcagcgcctttgtatcgcccgtacgctggcgatgaaacctgccgtgcttcttttagatgaaccggcttcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagtcttgtgaaggaagcggtgcacacacagaatttatttgatattcacggcatgaacgtatggtacggagcccatcaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacgggcgcaatctgctgaaggaaaagacggatgcggcagaattaagaaaacagatcggtatggtgtttcaaaaaggcaatccgtttccccagtcaatatttgagaatgtcgtgtacggtccgagaattcacggcgaaaaaaataaaaagaaactgcttgaaatcgccgaggaatctttaaaagcagctgcgctctgggatgaagtgaaggatcgccttcaccaacaggcgctttcactgtcaggcggtcagcagcagcggctgtgcatcgcaagagcgctcgccaccaaaccggacgtccttctgatggatgaaccgacgtccgctcttgatcccgtgtccacgcggaaaatagaagagctgattttgacattgaaagaaaagtatacaatcgtcattgtgactcataacatgcagcaggctgcgagggtctctgatcaaaccgcgtttttctatatgggcgaactggtggagtggggcgatacgggcaaaatattttctcagccggatcatcaaaaaacacatgattatatcaccggaaaattcggatgaaaaaaacgggcccggccattaaccgggtccgttttatatgtctattaaaaaagcctgccggccgtatccatctgaatggacgatgcctgcaagcttttttagcgggttaatgttttgacgatttttttaaagctcatatctgaatcgactttgaaatggccggcgcggatttctttgtggtagcctgcgtcaatgacgtaatcattgaagtctttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttatgctgatcgtcgaggtagctgtttacttctttttctgtcaatgctgttttttcggttttaacggcggctgcctggtcatggtcagtcaaatagaagacagcggcgagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggtttatgccgctgcttttggctttgcggatcacgaggttggtttccagcaattcttcttcaagcaccgtcattttctttttcaacttgtaaatttcctgcatggcggaaagctgaagcgtttctagctcctgttccacgtctttcatcggatctctttgagaatatgagaatgcaataagcgctatactgacgataaacaacgcaataatagcaatttccacgtttcatcaccttctattattaatttgcccttcttttttataccataaaacgccgccattctaaaggaaatagagaaaaaaacggaattttgtcggaaaatcttttttactcggggagcaaacggttatttctctatagatttcgtatcagaaagcccttttttgtcctgtttcgtcatattttaccttcttctgacgcaagctcattcagaggatcagaagcgtaaactgatgttttctgcacttaaacaacatttcatgtaaatcagctctagcattccgtccattatagtggtattatatataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaacacagcggaaaaagctggagctttcaataaagttctggcttttttgtctttcagggaggtttgagaaacgtgaaagcacaaatcagaaccgatataaaagcaaagctttctgacatgacagaaagtgaatgggagaaaaaatgccgcagcatgcgtgaaacgctgttttctttaaaagaatggagacaggcccgcgtgatcgccgttaccatctcgacacgcctggaaattccgacacggccgattattgaacaggcctggcaagagaaaaaacaagtctgtatcccaaaatgctttccgcagacgggagcaatggagttccgtacattttctgcgtatgatcagctggaaaccgtatatgcgggcctcagcgaaccgatcgagagtctgacggaaaaagccgcccaaaatgacattgaccttgtgattgtgcccggcgtggcttttgaccgggaaggcttcagaatcggatacggcggaggatattatgatcggtacctgtccggttataaaggccgtaccgtgtcgcttctctttgactgccagctgacagaccgcattccccgcatgccccacgatattccggtcgatatgatcgtgactgaatctgaaaccatcgcttaatcgcataaaaaactttttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggacattcattcatttctttttaaaaataccgtttatcagaaacaaattcattcagcaggcattttaaacaaatcccgttttttaagcgggattttttgcataagaaaacctgccggtaaaaaacggcaggttttctcgtattgtcagctttttttcaggaaaccgagcagaattgagattataggagaaatgtacaggaaaaaggtaaacggcaggtagtcgacgacggaaacccctaatgcgcttgccataaaagcgccgcttactccccagggaatcagcgggttgatcaaagttccgccgtcctcaagcgaccgcgcaaggtgaatccgcttaatgccgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcataatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcactaacagaggtgaaagaagcgaccaaggcgtaacgtgcacggcctcttttattccggaaatgaccgcctcaatattttgcgttgaagcggcatttattgaaacagatgaaccgagaatataaaaaagaacgatcgtgatcagcagtgccggaacggtggtgcccatcatatggcgaatatgcttaaaaatcggaatttcgccgattccggcggcaaaattcgtcgtgtcggacatcggtgacattttatcaccgaaacaagctccgcaaataactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacaaagcgtaaacggtgacggtgggaatggcgccgctgtacatccaggcgccgatcagcacaccgatcaaagccagcacgataatcggctgcaccccgttttttaatccgctgacaattcctttttcaagactctcccacgagaaaccgagccacaaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatattgtttatttcggtgacagacaagccgaaattgactttatgaaagatgaattaaaggaaatgtacttgtcaaacgtgattgaaagagatttatggcaaaaagccgccggagttcttcagagagaatcggagcggatcagaggcagttaacacagcaggattttaataagaaaaggagattattatggaagatacatggtttgcggggattgatctgggcggaacaaccatcaagctggcctttatcaacatgtacggtgaaattcagcataaatgggaagttccgaccgataaatccggaaacacaattacggtcacgatcgccaaagcgcttgatcagaagctggaagaactgaacaagccgaaacggattgtaaaatggatcggaatgggagcgcccggacctgtggaaatgacgacgggaatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgctcggaaccggagtcggcggaggcatcatcgtcaacggagaaatcgttcacggtaaaaacggggccggcggagaaatcggtcatatttgcagtattccggaaggaggagctccgtgcaattgcggaaaatccggctgcatcgaaacgattgcgtccgcaaccggcatcgtccgcatcgcgaaagaaaagcttgcggcggtttccgactcttcgctcttacaagtgcgcgatctgacggcacgtgacgtgttcgaagcggctaaacagcaggataagaccgcgcttgaagtcgtcgattatgtcgcaaaacatttaggcctcgtgctcggaaatctggcaagcgccatgaatccgacaaaaatcgtgctcggcggaggcgtgtctaaagcgggggaaatcctgcggtcaaaagtggaagagaccttcaaaatcaccgcgttcccgcgttctgcggaagcggccgatatttcgattgcggcacttggaaatgacgccggagtcatcggcggggcgtggattgccaaaaatgaatggctcaaacatcaaaactgctgaagaaagtctgcctgcccatatcgcgggcggctttctttttttatctcccctgtcatatagtttttaaaaaagggggatgaacatggcgggaattcgtgtcaaacctgaattgaaacagcatatgaaagatattgcaaaggtgctttcaattgatgaaaaactgttgaaagccgctgataaaacggcggaaagcgatgaattattttgtcccggctttgccgtgagcgggcagtcagagggtccgccgcttgagacgctgagcgggctttcgcgatacatccggcactgtgaaagcgttctttccgctgatcaatgggtgaaggaagaaaaggtgtacggctccgaatcggtttatgaagaaattgagaaaataacggatgtctttccgtttgtcacatgccgtaaaatcggcagttccgtattgggaaagccgctttatgagctgaaaataggtgcggatacggccgaaagaaaagtccatgtaaacgcctcatttcatgccaatgaatggatcaccacctcggtcgcgcttaaatggtgtaaagaatattccgtggcattatgcgaaaataaaaccgttttcgggcagtctgtgcttgatatattcagccggacatcattgtcattcgttccgctcgtaaatcccgacggtgttgatctcgtactttacggatgtgaagatttatcagaaaaaaaagaattcctcaacgaattaaatgagcaccgcccggatttccgcgaatggaaggcgaatataaacggtgtggatttaaataaacatttcccatccaattgggatattgaacaaaggcgcaaaccgaaagccccttcataccgtgattttccaggaacggcgccgctcactgaaccggaggcgcaggcgatgcaccggctgataacggaacagccacctgaccggctgatcgcgcttcatacgcagggagaagagatttactggggatacgaaggatgtgaaccggagcaatcatcccagatgattcgggagtttgaagcgataagcggaaaccgctatcaaggcgttaaaaccattgacagccatgccggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctgatgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggaaaaaacggaaggatggctggataacagaacaattctgtatacagcacatcatcagctgatgaaatatgatcttttcagcggaaaatccgaacggctctatgaaacaaagggcaatattgtcaatgtaaagatcagccggaaaaaacagctgattctcgtacaggtgacaagcagcggtcagactgagcttgtgcttatgaacaagcaggggaaaagactttatcacaaagcctttaactcttatgagctggagacggcttggaatccgtatgacccgtatcaaatgatgattaccgtttttactgaaacatgggacttcacagcctatacggccgatatgaacaacggcattttaaaaaagagtcccgttcaggccccttttgtccattggacctccactgatgaattccaatatatcaagcaaggaaaaacggaggaagagggtcctttatattcttatgacttgcagacgaaaaaagaaaaaagagtgcttcatcacgtcatctgggctgattcccgcccgggcatgacgattgccgtcagaccaacggatcaatcggacggagacggcgagttctttttccaaaagccggcatccgtgacacaccgctttcctctccaaaaaaagtatgagagcttcgcgccgatggaatatgattacgatcagacacacaagcggttttacatatttaagcctgaaggccgctcttacaatctgatcagctttgacttaggagacgaacgggagcggacggtgctcaaaaacacggaaatggagccgattcagatctctccgaacggggaatacgctttatacggctttacgtatgaccgtctgatttcactgaaaacgggcatgacagaaccaatcataacaaatgaaaaaggagtttgaaccaaatggcaattgcagatgtcacaatcattccgatcggaacaaaaacaccgagcgtcagtgagtatgtagcggatgtgcaaaaaattttggagggttacaaagctgccggcaaaatcaaatttcagctcacgccgatgaacacgttgattgaaggtgagctgagcgacttattcgcagtcattcaggatattcacgaagccccgttccaaaaagggctgcacagagtggcgacaaatatccgcattgatgacagacgtgataaagaaacgacgctggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagcgtggcggcggctaacaaaaatcccaggatatttctctgtctgacagcccgcaggactcctaatacagctaataatgcgacaaggccgaagattacaacaagtaacatcatgctcctcctttgtcattggaacctgaaaatctttccatttcattttaaccgttttcattttgtttgtcgatagcgttttcccggccgcattcattgaatcttccgcagaaaaccttcataataagggcatatacataaagaggtgatgaaagtgaaatggagacgaatgccggccgggccgattcaggcaaacgcgtattttcttgtcagtgaggatcagtcctgtcttatttttgatccgggcggggaagcggacaaaatcaacaattacataaaagaaaacaatctgaagccgctggccatcttactgacgcacgctcattttgaccatatcggcgcacttgacgaagtaagagacagatgggatgttcccgtataccttcacaaaaatgaagaaaagtggctggaggactcttccttaaacggatcaggcatattgcggggcatcgccgtaacggcacggcccgccgaacggctcatcgaaggcgacggcattttggacatcgggcctttccatttggagacattgtttacgccgggacattcaccgggaagcgtttcttattatgtgaaggacgcggatctggtgatttcaggtgatgtgctctttcagggaggcatcggccgaactgatttacacggcggaagtcaggacgtattgcttgattccattcatcaaaaactgctcacgcttcccggacatacacttgtgttaagcgggcacgggccggaaacggacatccagacagagcaggagcgaaacccgtttatcaatggtttttcactgtaaatgaaaaaagacagaccataatcggtctgtctttttctgttcagtgggttccgccgcccggtgtcataataaaaatagagtagtatgtaaatccggcgaaaaatacggttaagtaagctccgaaaatataaatatacatccgctcagtcagattcaaataagaaagaaatacgaaaaagatcgtctgtccaaaaaacaaaagagaagcgtctttcatgccccctagaaaaaacatgactgcaaatatccccgtccaaaatcctaacacccggaacatgcgattcattccttatcccctcccgagagtctatctgaagtttattataatagatcggcactcaaaatgtaaacattttcatgattatatttattgtggaatttatgtctttccctgtgttttatatcttatgccgttctctaaaaaagatccgaaaaatctttttgaaatacgtttagggaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgacatctattcagggagacaccgacaattgatgaattgaaacagatcttatcattaacgaccgaaggaattgatgaaatattggcgacgagaagccaaacatttaaaaacctcaacctcaacattgaagaaatgactgtaaatgaagtgctgaagcttttgactgagaagccgaaactgctgcggcgtccgattctgatcgatcgcaataagctcgttatcggatacaatccgggagaactgatgaagctgacgaagaaaaaaacggtacatcaatctgtatcataagagaaaaacgaagatccgctgatcaaatttatcagctaatcttcgttttttgcggttgcgggactgggctagctggattcgaaccaacgatcacggagtcaaagtccattgccttaccgcttggctatagcccatcggatgtaattacagtatgtgcgtccggcgccgatttatacatacaaagtaatttgaatggaggagacccgtgaaacatttgaatgaaacattatctcgaaccttaattgaagaatcaggtgaaatcacacgccagtggctgctcataccaaaatcggggcggccttcagatgatcagaaagcggaaatgcagcaccgtctgttaattgaaatcgttgccggcattttatcggaaaaagaaggcggagaagaggagctgacaaagtgggcgcttcagttcgcaagggaccgggccgtccatgaagtaccggtctatgaaagcgtcacgagctttaaagaattccggagattggtctggaaccgtatacagacatgctgcgaaacgatgtctgagaagcccggggcgaatgcggtattccattggggagagaagctgaacaaagcaattgaccatatgattgaagtatttacagaggaatattataaagtgacggttacacaattaaacgcccaaaaggaaatgattaacgaactgagcgcgccgattatgccgattgccgccggtattggaattttgccgcttgtcggcgaaattgatacctaccgggcaaaaatgattttggaatcggtgcttgaccaatgttcttcactccggctttcttatttatttttagatatatcaggtgtgccgattgtggatacgatggtcgcttatcagattttcaaagtgattgacagcacaaaacttctcggcatagaaacgacaatctcaggcatcaggccggaaatcgcgcagaccgtcgtgaagctcggcatcgatttttctcaggtgaaaacggagcagagtctggcgaaggcgctggcaaaaaacggatttatcgtaaaagaatcattaagatgataaaaagctgaatggccgggagggatttctccctcagctattcagctttgtcagcttcaatcgtcatgatatgatggctgtcgatttcttttaccgtaaatgtgtagccttcaaaatcaatggtgctcccgggcttcgcgtcaatatgctgagtaagaaaccagcccccagtgtatcgacttgatcagccgtaatctctgttccgagtaaatcattgacgtcactgatcagcaatttggcgttcaggagatagcggttcttcccaagcttttgaacggaaggtgtttcgtccgtatcaaattcgtcgcggatttcgccgacgatctcttcaatgatatcttccgccgttactaaccccgcggttccgccgtattcatcaatgagaatggccatatgggcgtgttcccgctgcattttaacgaacaattgataaatcggaatcgtctcaatcacatggatcgccggctgaatgtaagggctgagttcgtgttttgtaaacgccgctccttctgacaggaatctgaataaaacttcttttatattgatgatgccgactacatgatctttatctccttttacgacgggataccgggtatatttatttgttttgataatgtcccggagcatatgtcccgatccgctgtctaacggcaggctcaccatttcattccggggcaccataatttctttggcagtgcgcttatcaaatgtaaaaatgttatttacgtaatgcagctcactttttttgatcatgccgcttcgatagctttcggcaaggagcacccgcaattcctcttccgtataagccatttcatgttcggaagcaggcttcaagccgaacatggctgtaatcaggcgggcggaatgattgagcagccagatgaacggaaacattaacttataaaacaaaatcatcggtctggcagacaaaagtgtaatccgctcggctttttggatagcaaaacttttcggggcgagttcgccgatgacgacattcacatatgtaaccagcagaaaggcgatgatcaatgacagtacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacatcttcctcaatgagctgattaatacgggagcgccttgctttaacgattgaaaactctatggcgacaaaacacgccgttaataatataaatagtacgatggcggatagtttgatgatatacaatgtaacgccttccgcgaaggaaggcttgcacctcccttttttcggaataataccactgtagaaagctgctcaaacatcgaacctggtttagcccgcctcatttacggtaataaaacaagaaagcgatactggaggatgacaagagatgaaggtacattcgggtgcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggatctttaatctatcatcaaggattagatgatgaaaaaaaccataccgtatttcacttttatattacgagagacttcttttttacgattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctaaaaaagtggaaatggctttaaaagaagcgtttcttccgaaaaatgacaggcagaaagattacctcagagctcatcataagatggaaagagggattacatatatcaatgagtttgatcaggaactgagcaatctgctgcacgccgaggaagtcattacctcccaaagaggaaatgaaattgtgaaagccttgacgatttttacaactctctttacaccgatgacggcgcttggagctctctgggggatgaactttgataacatgccggagcttcattggaaatatgcgtatatctgttccatcgtgctcattattgtatcaaccctgctgatttatatttatttgcggcagaaaggctggacaggggacattttgagggagcatcaaaaaaaatatttgcggaaagaaaagaaacgctaagaagagcaggcatacgcctgcttttttgatggctgaaaatggccgaatggttccggatttcattcagtaaatcaatgtcagggggcttattttttatttttttgcgttttacacagtgtaaaacgcataatctctcctttgccggcttttgtgtatctgatttacaatacgtgcggaaggagggaagtcttgtgaaaaatattgaaacatacagcaggaacatcataaacgaggcctatacggcaagggcttcagatatacacattgtgccgagagaaaaggatgctttcattcattttcgcatcggccatgctcttgtgaaaaaaagagtcttaaaaaaagaggaatgcgtaaggcttatttctcatttcaagtttttatcggccatggatataggagaaagacgtaagccgcaaaacggttcattgtctctgccgcttccgacggaaaccgttcatttgagaatgtcaaccttgccgacaatgaatgatgaaagtcttgtcatcaggcttttgcctaagcggcagattccccctctggataaactgtccttatttcggggggcgggcgccgcactattgtcctttctgaagcattcacacggcctgcttctgtttaccggcccgaccggctctggaaaaacgaccactctttactcgcttgtcaactatgcaaaacggcatttcaaccggcggattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagagatgccgaaacggctgaaatcgcagtccgcgcggccatgacgggacacctcgttctttcaagcctgcatacaagagatgctaagggcgccatatacaggctgctggagtttggggtgaacatgacagaaattgaacaaaccgtcattgccattgccgctcagcgtctggttgatttaacatgtccgttctgcaaagaggaaaactgttccgtgtactgccggatgtacaggcagacccgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacaaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgaaactccagctgcataaacgtcagcttgcagagctgacggacggaatccgcaggctgagggaaggtgatgcgttttacgaagtgcttgaggcactgtcttttcataaagaagccgtctctatctgctatttcgcggagaaacacggagaattgccgggggcgatgaaacaaagcggcgatttgttacagagaaagctcatgcagacgaatcaaatcaaaaaaatgctccggtatccgatgtttttaatttcttccgtctgtgtcatgttttatatcctgcaaagtttaattattccgcagttttctgggatttatcaatcaatgaatatgaatacatccggtgcgactgctttcatctttgcattttttcggcattttcatgaagcctgcgcactggcgctgtccgccgctttctgcttgtttttgtacgtttggttcttatgtaagaaaaaatccccgcaagataaaatgctcattgttgtgaaaatacccctcttgggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtgttatgaaaaagatcttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcgtctgaaaaatcaagatgggtttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgaccatgaaggtaaaatgccggatatgaacgatttacaatcagaggggtatatcaaaaagaatacagcctgcccgaatggtaaacagatcttaattagtggcggagaagttacagttgaacaataacaggcggacagaaaacgggtttacccttcttgaaagcctgattgtgttaagcctggcgtccgtcctgctgacggttttgttcacgacggttccgccggtctgcacccaccttgccgtgcggcaaaaaacagaacagcttcaaaaagatattcagcttgcgcaggaaacggctatcgcagaacataaaagaacaaaaatcacttttcttccaagagagcataaatacaaactgcagtcagccggaaggattgtcgagcgttcttttgattcgcttcacattacacttgtgactttaccggagagccttgaatttaacgaaaaaggccatccgaattcgggaggaaagattcgattgaagagcgccgggttcacctatgagatcacagtttacttagggagcggaaatgtccatgctaaacggaaataaagggttctctactattgaaacactatcagcaatggccatttggctgttccttatgacgtctatcattccggtctggacaggcatgctgacagatggtctgaaaatagaagatcgccaggaagcgtatcagcttcttcagaaacatatcagcacttatatgatgaccggaaaaaagccgccgtctcccggtgtgaagtggaagggggatggtgagtattacaaagtgtgtgcggctgaccgcggcgaaaaagaaatgtgcctcagcattctcaaaacagactggctttacgcttcttaatgttttgttctccttggcagtctgtcttttcctatcaggcaccctgggcccgattttacatctgtttttatcaaaccggaccgataacggcggattagacagccgggagcatcaaattgccgttcagcagatcatgaacgaatgtaaacaggctgagactgtgaagccggcggacggcggattggcgttagcatgccggaaaacagggggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttacaggtaaaaagaatcaggcggtcattccggtttacagctctttaaaaggtgattaaatgtacaaatctgacggttttatctatcccgcggttctgtttgtttctgccgcagttttacttgtcatcagctatacttcatctgatttcatcacccgaaaaacatttgcgaaagaggccggggagtactggatcggagagaatctgctccaaaacggcgcgctgctgtcaagccgccatatgacacagggacaaaaggtccaaactggtacacagcgttttccgtacggaactgtttccttccgcatcaccgggagtaatcgccgggaaacggttcaggttacaattcaggccgaaacagtgtcaggcacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtacagttttaagctgtggatgcagcggaaaaaataaagcgaatcacacataaggtcctcctgtatcaggagggccttattggtattcctcaatgacggcaattttatttaccttttggctgtagggattaaaagaaatcgtaacaaacacaccaaattcttttgcgccatcccgcaatgtcaagtggtattgtttgactgcttcgtccgttcttttccggtcccacaccttttgaataaataacgtttgggcgagcggatatctttttttagcttctttttctgctaacttttcccattttgatttatggtgaacagcataataaggcaccgtttccgcctgagctgttcctgaaaccccgaaaacaagaagagaaaggcaaatcagactttgtgtgatcatcattcttcgtcctttcgctgtatatactttccattttgtgctaggcacctcgttattttctcacgttttattagaaaaaattccaaaaaggtgtgtaatttgaagcaaaacgatgtttttgaaagataccattctcaaaaacgaacaaattgaccgattttgacatttttcaagacgataatccttgattatactttgttcatgaagttctttaaagagaacggttgtcatatttattaacagttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtgaaaagcttcagtctcccggttcaaacgtgcggagattttcaatatacggatgacgattgccgttatgacgaacgctgggatcagagtgatttacatataacaaatcaaactgatacgtcaggcaccgtgtgtgcgccgcttcaactctatgccgagctggagaataagggaaaagagcggactgtttctgactggaaatgggagctccataaaatcacttctcagcagcagcctttacgaaacggcaatgttgtggataaagggcttattactgataaaaaaagcaaaacgatttataaaattgagtcaaagcggtctttgcagccgggcatatacgcattcaagatttacaagcctgaagggtatccggcggacgaagaacaatttgagtggtcaaaaccgatgaaactcgtcaaatgccgggaacaggcaaccgtttccgatctgaagaaaacggagaaagagccggctgagccggtaaaagaaagcggggaagaacatgaaaaaaacgctgaaactgatcagtaatattttgtatgccgtcatcttcagcctgattattgtgctgacgttaacggtgatttcgacccgggcttccgggggtgagccggccatcttcggctatacgctgaaatccgtgctgtcgggttcaatggacccggaatttaagacgggttcgctcatagcggtaaagaaaatttctgacgtaaatgacttaaaaaaaggggatgtgatcacctttacgcaagatgacggaacagccgtcacacacagaataatcgggatcacaaaaaaggacgggaacctgctgtttgagacaaaaggggaccataatgccgccccggatgccgcccccgttcaagctgaaaaagtggcggcccagtatacgggatatcagcttccgtatgcgggatatgtcatacatttggcaagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagagaaccatctccacatgaatacggttgcaacctggcgacaggatttgataacaaaaaataaaaagtaaggggagtacaaacatgggtatgaaaaagaaattaagcttgggcgttgcctctgccgcactcggtttagcattagtaggaggaggcacatgggccgcatttaatgatgtgaagtcgacggacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggcaatgaatctgcggaggatttcctcagccagtttgaaattacggttctgacagtcggtaaagaagggggcaacggctatcctaaaaatatcattttaaaggcggccagcctgaaagacttatacttaatgtcaacaaagcaggataaagcagctgccgaagcgatcagcaagcacattgatccgaaattcctgagcgagagcggaaaagtcaatgtggcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagccacgcaatggaacggcttgaccattaagaaagatcatacggataaagacggttacgtcaaagaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcttctgtctgctcataaaactgatcgagcagcctgaggtcctttttccatctggcgatcgcgctgtcagcccagtctgacggctctttggcggcagcgtcttttaagtaatgctccatccttttaatcccgctttccggcttaatcatcggcgatatggtaaagcaatagtctgatatttgcgaggtcagcggaagcggtgcaagcttctgctgaaacccttctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaactcgccgtccatatcctccggagccgtttctttatcagtgatgaacgtaatcttcatcgggttcggttcgccgcccgttttttcacgccaatgccaataaaacgggcggttcataatttgtttgtccatctcgaccgtcaactgaaccgtcataaaacccggcccgtgttctgtaatcgggcagtggttcgcttcaaaaaagcgcagtaaaaattggtgaacctcctgctgtctcatgtcgcgcttcctcctttttaagagcctttttttctggcgggcttttccgtaccgtacgacagaaaagaggtgagattgtccattttgattctcatttcctcctctgtcagcgaatggcataaaatatcatgcaaatggtcttcaaaattgctcactttgatttttgttaaaatgtcatctaattctccgacgacattttcaaataaatgaattttgtcatacagaagttttaagatatgctcttccaccgtatgttttgtcgccatattgtagatatggacatctctttcctgaccgagtctgtgaatccttccgattctttgttcaagccgcatcgggttccacgggaggtcataattgataatatggttgcagaattgcaggttgatcccttcgcctccggcttctgtagcgatcagcacctgcactttgccgcggaaaagatccttcatccagtctttttttccgcgtttaaatccgcctctgaacggaacggagcttatgccgttctgctgaaggaaccattgcaggtaaatctgtgtcgccctgtattcagtaaaaataatgactttatcattaatcttttggatcaagtcaacaacttgaatcgcttttgagttttgcgtgacttgattgatgcggtccattaaattagcgatcgtctgttcatcgaatgcgggcgcttgtttgtctttttggtcaagcatttttttgagcgtcatatacacggcttccctgcttgaacagcactctctttgcagcgtcataatggaaaatgcgcttgcgggcttttccgtgccgtttttcagtgcggcaatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcatttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggggagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagctctcaacccttcaaattcaggaatggcaagggtctgctggacttcagccgacagtttgtacagctcccaatttgaccagggaccgtccgttttcagccgctcagaaaactctcccggccagtttgcatcaaatatgatctctgctgtcatatgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagaagcaggccaccaaaggggacgtctttatgatatgttcataaagtaaactttcaggtgccgggacagagaaaccttcattttcatgaggtgtttctctgtccttttttatatgtttttacaagcgccaatgactgaagggggaagatgatgctgaaacgaacaccgctttatgatgtgtataaagaatacggcggaaaaacgattgattttggaggatgggagctgccggttcaattttcttctattaaagaggagcatgaagccgtccgcacaaaagcgggcctgtttgatgtgtctcatatgggggaagttgaagtatccggtaaagacgccctgtcttttctgcaaaaaatgatgacaaatgacgttgccgatttaaagccgggaaacgcgctttataccgccatgtgctatcctgacggcggtacggtcgatgatttgctgatctatcagaaaagcgagagctgctatctgctcgtgataaacgcgtctaatattgaaaaagacatcgcctggctgacagaacatgcggaaggagatgtcacgctgacgaatcagtctgacgggatttcactgcttgccgttcaggggccgaatgctcagtcggttcttgcgaagctgactgaatgtgatctgtcctccttaaagccgtttgcatttattgacgaggcggacgttgccggacgccaagtcctgctttcaagaacaggctataccggtgaagacgggtttgagttatattgccgcaatgaagatgcggttcatctatttaaggagatacttgcagcgggagagcatgaaggcctcgttccgtgcggcctcggcgcccgtgatacgctgagatttgaagcgaagcttgctttatacggtcaggaattgacgaaagatattacaccgattgaagccggaatcggatttgccgtgaaacacaagaaagattccgattttttcgggaaatctgtattgcgtgaacagaaagaaaaaggagccccgcgaaagctggtcggacttgagatgattgaaaaagggattccgagacacgggtacgccgtgaaaaaagacggtgttccgatcggggaagtcacgacaggcacgcaatctccgactttaaagaaaaatatcggccttgccttaatcaaaacggaattcagtgaagtcggaacggaagtagaagtggaaatccgtaaaaaaacggtaaaagcgaagatagtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaagatgtgaggtttcaaaaagactaccaaattaaaaaagcaaaatctgaaacggagctgacgagagagctgacaaagcttgcggcgaaaaataaggacgctgttacatatgcgtcttttctgggcgcaggagtgtacgatcactaccagccggtcatcgtcgatcatgtgatatcccgatcagagttttacacggcatatacgccttatcagcctgaaatttcacaaggggagctgcaggcgatttttgaatttcaaacgatgatctgtgaattaacgggaatggatatcgcaaactcctctatgtacgacgggggaacggcgcttgcggaagcggcgatgcttgcgtcgggacatacgaaaaagaaaaaaatcattatttccgcagccgttcatccggaatcacgggatgttttgaaaacatacgcaaagggccaatatattgaggttgtagaggtgcccgcgaaaaacggcgtcacagatcttgaagcattggaacatgccgtttgtgatgagacggccgccgtgatcgttcagtatccgaacttcttcggacaaatcgagccgttaaaggacattgagccgctcgcacataaaggaaacagccagctgattgtttcttcaaacccgctcgcgctcggtattttgacaccgcccggggcatacggagctgatattgtcgtcggagacgcgcagcctttcggcatacctgcggcgttcggcggcccgcactgcggctattttgcagtaacgaaaaaactgatgagaaaggtgccgggccggcttgtcggccaaacagaggatgaaaacgggcgaagaggttttgttctcacccttcaggcgcgcgagcagcatatcagaagagacaaagccacgtctaacatttgttcaaatcaggcgctgaatgctttagcggcttcagtcgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgtcaaggaagcaaaccggcggctcctgcaagacggcatcatcggcggatatgacttaggtcttgcgtatccggaactggatcagcatatgctgattgccgtcacagagctgagaacgaaagaagagatcgattcgcttattgcgggattgggggatcaacatgaataatcaagatcaggcgcttatttttgaaatgtcccgcgaagggcgtgtcggttacagccttccggagcttgatgtgccggaaacagagcttgaaagccttcttcccggtgactatatccgcgatgaagacgcaaagctgccggaagtatcagagcttgatattatgcggcattataccgctctttctaagagaaaccacggagttgattcaggcttttatccgctcggctcctgtacgatgaaatacaatccgaaattaaatgaaaaaattgcccggttcgcaggtttctccgctattcatccgcttcaggacgaggacacggttcagggggcgcttgagcttttatacgatttaagcggacacttggaggagattacgggcatggacgaggtgacgctacagcctgcggcgggcgctcacggcgaatggaccggcctgatgatgatccgcgcctaccacgaagcgcggggagacttcggacggacgaaggtgattgtccctgattcagcccacggtacgaatccggcatccgccacggtcgccggttttgaaacgattaccgttaagtcaaatgagcacgggctggttgacattgaagatttgaaaagagcggtaaacgaagaaacagcggcgctgatgctgacgaatccgaacaccctcgggttatttgaagaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggctcagggccagtcggagtgaaaaaagaattcattccgtatctgccgaaacccgttctcacgaaaaaagagggccgtttgacttttgactatgaccggccgcagtcgatcgggcgcgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtttgaccgtcattgcaagcatgaatttgtgttatcgggaagaaggcagaaaaagctcggcgtaagaacgcttgatattgccaaacggcttttggatttcggctatcatccgccgactgtgtattttcctctcaatgttgaagaaagcatcatgatcgaaccgacggaaacggaatcgaaggaaacgcttgatgcgtttatagatgccatgattcaaattgcgcgggaagcggaggaatcgcctgaaatcgttcaggaggcgccgcatacaacagttgtcaaaagaatggatgaaaccaaggcggctagaaagccggttttaaaatacgaacgtacacctgacgtcagccgctgacacggtataaaaaaagagcttccgtataaaacggacagctcttttttcatgattagttttttgctttaatttttccgccccattttttaaatccgcctttcaggttgtaaatatctttgcagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatgaccgccttcaaattcattcggttcacggacgtcaatcagctgcgcttttctgtagcccgcgcggaattcctcttccgtaagtgttttcattaaacgctgctggtaaaagtacgaaacgatcatataaacgataaacgccgcaacaataattaaagcaatcatattagacaatgcaattctactcctttagcttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactggttttattaaaacgataaagaagggttcagtgtatggaaaaagaaacatggcggtttattgactcagggaatgaaagcccggcatttaacatggcgctggatgaagcgcttttatattggcacagccaaaaaaaaattcctccggtgatccgtttttacggctggaatccggcaactttgtctgtcgggtattttcaaaatattaagaaggaaattaactttgacgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacggagaaagaaaaagaaagcttgaaaaatccgcgctcgtccgtctgctttgatgccccttcgtggtatgagctggtcgtcgaaggacggaaagttgccggaagcgcacagacacgccaaaaaggcgtcattcttcagcacggttccatcctgcttgacattgatgaggataagctgtttgatctgtttttatatccgagcgacagagtccgtgagcgcatgcagcggaatttcaaaaacaaagcggtagccatcaacgccttaacgccgaaacgggtaacgatggatgaggccagaatcgcttttaaagccggttttgaggaagggctgaacattcatcttgagccttacacactcacgtctgaagagcttgcatttgtcaatgagctggctgagacgaaatacgcgtctgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccaccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggcggggggataaaaggggtggcgcttgccggcgcttatgaagcgctggaagaaaagggctttcgctttgaaaggctcgccggaacaagcgccggcgcgattattgccgcatttatcgctgcgggctatacgagcagagaggttcattccatcatagatgaggtggacggaaggcaattgcttgatcagagatactcattcctcccgctgaaaatcctgcagtgggtgtcgatatattggcgcctcggactatacagaggcgatatgctggaaaagtggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagaccgaaaaaggcacctcaacggtcgttgacggcggcgtgttaagcaatttcccgatttggctgtattcaaaagaacgcaaacggccggtcatcggaatttcgctttcgcccaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtgatggcgacggagtttcatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttttgaaagcggttccgtcacggccggtgcgtcggttcaggaccgtcctcacgataaaataaataataatgcctgcgataataacggtgattgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggattttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggggatattccgtactctgttcgtcagctggagcacttcaaaggagatgccgagaacgaccggtataagcgcaatcctgtctaaaatccgcacccaaagcggatctgtcggaacgagtaaatagacgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaatcagcttaaacagactttcgattccgatctgcgcggcgtctgaggaaaatacgggccttacaagctccgctaagaagaccgggacgagcgtaaaaacgaatttgctgaacaaaaacgacagaacgccgatcaccgccaggctgaaaaacatcgataagccggaacccttcttctcttcctgctccagcttggcgtcatcctgaggatcaagcccgtaacgttcgctggaaaagtttaaatgctttgtgccgttggcgctcgcctcaatgatggcgacaattccccgcaaaaaaggaatcttttttaaagccgaaagcttggcgttcggcactctcggaagcttgaaaaaatcaatgcttccgtcattcctgcggatggcggtaacataattttttctgccgccgaacattaccccttcaacgacagcctgcccgccgtatgcagggggcgttttttgtttggacattgtttatcaacctgcctgttttcttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaatttttgggcagtctatgactggaggtgccatgatgacaagcgaaaaacattcagaacaggaagaaaaaaagaagcaggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctgggcacgatggtcagcatcgttgtcatcggattcatttcaattgccggggcgtttatttatttcgtctgcctgaagcgttttaaaaccatgtggccggggatggtgtacggcgtcattttatggtgtgcggtttttttcttattcaatccgattttcgaagatgtgaaatccgtcactgaattgaaatcagatacaatcgtgacgacgctttgcctttacattctgtacggtttgtttgtcggctactcaatttccttcaactacaatgaacttacgtcagacaagcttgcaagggcgctcggcaacaagtgaataagtgtataatccctgtccggtatggtaaaatgttcacgagaagtgaacattttttatgctgaaaaccgggcagggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtacatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggatgccctgacgagggatcatatcaccgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagtcgggggcgcaagaatcgaagatgatatcatcatcactgaggacggcaaccggacaattacgcattcccctaaagaattaattattttgtgatcggagtataggaggacatcaaacatgatttcagttaacgattttcgtacaggactaacgattgaagtagacggcggcatttggcgcgtcgttgactttcagcacgtaaaaccgggaaaaggagcggcatttgtccgttctaaattgcgtaacctgcgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaataccttctggaaaatatgtctgtgcatatcatgatgtatcagtctgaaacgctcggtattgaactgccgaacacagttgaactgaaagttgttgaaacagagccgggaattaaaggcgacacggcgtcaggcggcacgaaacctgccaaaacggaaacaggccttgtcgtaaacgtaccgttcttcgtgaacgaaggcgatacgctggttgtaaatacatcagacggttcttacgtgtcaagagcgtagttaaagaaattcggagtctgctccttttacggggcaggcttttttttgcgttctgcctcagaatctttcttctatatgaaaatagtgagactacttccgtgagctagagcatatagtgtaacaaaatgcttgaagttgggggattgcaatgaaatttttgttcggttcaatcaattctactgttttaacgatggccggtttacgagttttgtcctcgctcattgaattatctgccgctattatcatgcttttgacaaacgacatcagaaaagcggttgtggtgaatagtattttggcaatcgtcggccctctgatctttatcatcacaatgacgatcggcatttatcagattgccggacagctctcatatgcaaaattaatattgatttttgcgggtgtggtgctgattttggccggtgtgcataaatagagggccggggtgtcataaagtctgtcccggatcatacattttaaagaagccaatcggtaaaaaggaggggactctattgaatgaaattacagaggttctccctgaattattgagagatgccatctccgccgtgcccgaagaagcgaggcgggatacagaagaaatcagaatccgggtcgacaggccggttgaactgatccaaaaaggacaacctttgtatttgtcatatgtgtgtacggccggcgacgcacagctgatcctcagccggctcagcaactatagtatgtacacgctggaagaagagctgaaaaaaggatacatcacaatcagaggaggccaccgtgtggggctggccggaagagtcatcgtcgaaaacggagccgtcaaaggactccgggatattacttcttttaatatccgaatcgcccgggagaagctggggatcgcagaaccgctcattcctttcttatggaaagaaaactggctgaacacgctgatcatcggtcctccgcaaacggggaaaacgaccttgcttcgtgatttggcccggctttccagcaccggatcaaaacgcattccggcaaaaaagacaggtatcgtagatgaacggtcggaaattgccggctgcctgcggggcattccccagcacagtttcggccgcagagtcgatgtccttgatgcctgtccgaaggcggaagggctgatgatgatgatccgttctatgagtcctgatgtcataattgtggatgaaatcgggagaatggaagactcacaagcgctgctggaggcgctccatgcgggcgtatccgttatcgtctctgcgcacggatggaatatgaaagacttggtcaagaggccgtcgctgaaaatgctttgggaggaaaacgtgtttgaccggtatgttgaactgtcaagacgccgcggtccgggaacgatcagcaggatgtacggaaaggacgggaaacctgttccgcatgctgaaagcgtgatgacatgctgaagcttttgggtgccgtgttcattctgacagcgacgacatggacgggatttgagatcgccaaaatgtatattgaaaggccgagacagatccgtcagctgcgcgcggcgctgcaatcgcttgaagcggaaatcatgttcgggcatacgccgctgcacatagcttcgggacaaatcgccgcacagctttccaagcctgtatcgtcattgtttcaagctttcagcaggaggcttgagcagggaagcgattccgccaaaacggcctgggaacagagcttgaaacataactggccctccatggcgatgaaaaaaagcgaatacgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgaccaaatgggaaaaaaagaatacgcccaatgggtgacgctgcttggctttatctatattttatttatggtggcgacgattgtcgatgacctgttcaaaaagatcaaagctgtgtttctattccaaggatagggggcttacagattgagattgttcaaattgtaggtttaggcctgatcgccacatttctctccctgatcgtaaaagaacagaaaccgactttcgcgtttatgattgtcgtcttcagcggctgcgtgatctttctctatctcatcgatcagatttacgacattatcagaatgatagaaaaaatagccgtcaatgcaaatgtcaatatggtctatgtggaaaccattttaaaaattatcggcatcgcctacatcgctgaattcggtgcgcagctgacaaaggatgcgggccagggagcgattgcttcgaaaatagagctggccggaaaaattttgatactggtaatggccgtgccgatactcaccgtcattattgaaacgattctcggacttattccttcttgatcatcaataaaatggaaaggggggcacaaaaaatgaagcgctttcggtgggcgggggcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcatcgactttattaacggtgaaaaaacgttctcgccggaggcatggctgaaggctttattttcatacttgtttcatgaagtgctcgcaaacggaaagcttctgggaactttgattcttctcaccattttttgtgtcattctgcagcttttgcaaaatgcgtttcagcagagcactgtcagcaaagtggcttatgcaatcgtctacatggtgctgattattctcgctttaaacagctttcatgttgccgtcaattatgccagtgaagcgatccagacgatgacaagtttcattctcgcgctcatcccgcttttactcgcgcttttggcgtcttccgggggagccgtctccgcagctttttttcaccccgttattttatttctgatgaatacgagcggccttctcattcaaaacattgtcatgccgcttattttcctgtcagcgattttaagcatcgtcagcacgatgacggatcaatataaagtcacgcagcttgccaatctgctcagaaatatcgcgatcggcgcgcttgccgtatttctcaccgtgtttctcggcgtcatctccgtacagggggcttcggctgccgtgacggacgggattacgctcaggactgcaaaatttatcacaggcaattttattcccgtgctcggccggatgtttacggatgcgacggatacggtcatcagcgcatcgctcctattaaaaaacaccgtgggaatcctaggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagccgaagcgtgctgtatattttcgcggcgctcgccatcgtctctctcatgtttttcctcagtattacagtcattattacagcaggcaacctcaccatgatgatgaaataaaggaggcccattggatatgagctttttaacagaatggctgacaagcattattttgtttatcttattcgccatcgtcatcgacatgctgctgcccagctccagtatgcaaaaatacgccaagatggttgtcagcctgctgttaatcattgtcatgctcaacccgatcttcaaacttttcaaaacagacccggaaatcatcttcgattatttgacaaaacaagagcaatctcaatccgctgatataaaaaatcaaatcaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgaaaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattactttctgttcgtgtttgtgctcggagtatcttttatgctggtgagccagctgttctcttcaccggagaaaaccgggaaggaccaagcggcgcagaccgtcatgtccggccgaacggaagacaaaagcgggcaaaaaagcgcacccgtttttaaggcatcgaaagacagcagcgccaaaaacacgatcgatgattatgaaagagactatgaaaaccagctgaaagaaatccttgaaacgattatcggcgtggaggatgtatcaattgtcgtgaacgtagacgcaacatctttgaaagtgtttgagaaaaataaaacgaaaaaagacaccaccaccgaagaaaccgataaagaaggcggcaaaagaagcgtaaccgatcaaacctctgaagaacaaattgtcatgattcgaaacggggatcaggaaaccccggtcgtcgtccagacgaaaaagcccgatatccgcggtgtactcgttgtcgctcagggagtggacaacgttcaaataaaaaaaaccatcattgatgccgtcacaagggtgcttgatgttccgagctaccgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtggcaactgaaaaaacgccggctcctgaaacgaaagataagaacggaagcggcacggataaagaagacggaacaaaaggaacgaaagattctaaaggcgcaaaagaggataaagaaacatcagccgaagcatcggacaaagacggatcggtcgctacagaaacagctgatgaaaacttatttaccgcataccgcatggaacttgaagacgcaagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattacggtcatgtctgacaaacattcaaacgcaaaagcttccgctatcattgacctggtggaaaaagaaatcaagacgatgaaagacgtcgccgtcacgtttgaaccgacaaaataagagatctccaccgcccgcacccgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaattcgtttacgaaatcgaaggcgtaagcctcaaactgaaaaaaaatgaagcgccggcagtgaatgtaacgggacaagctcaagccgttcccgccgcttacgcacctgctccgcaggctgcaaaaccggaagcgcatgaagccgctcctgttcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaggaattgaacgtaacgtttgtcggccctacggctgacgccatttcaaaaatgggaacaaaagatatcgcgcgcgacacgatgcagctggctggtgtgccgattgtgcccggttcaaaaggaatcataaaaaataccgaagaagcggtttcgcttgcaggtgaaattgggtatcctgtgattataaaagccactgcgggcggaggcggaaaaggcatccgggtcgcacgcacagaagaagaactgatcaaaggcattgagattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggcgaagctgcggtaaaagcagcgaaggccgtcggttacacgggagccggcacagtagaattcatttatgactacagagaacagcgctactacttcatggaaatgaacacgcgtattcaagtagagcaccctgtcacagaaatggtgacgggaacggatctgatcaaagaacagatcaaagtggcatccggacaggagctttcgctcagacaggaagacgttgaatttaacggctgggcgattgaatgccgcatcaatgctgaaaatcctgcgaaaaacttcatgccttcacccggtaaaattaacatgtacctgccgccgggcggactcggcgtacgcgtggattcagccgcatatcccggctattcgatcccgccgtactatgacagtatgattgctaaagtcatcacatacggaacaacgcgtgatgaggcagtcgcacggatgaaacgcgcgctgagcgaattcgtgattgaaggtattgaaacgacgattccgttccatctgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgacgaggctcatttaggcaaggttgaaattgctcctgaggtcattgaagtcattgccggcatcgccgcttccgaagttgaaggagttgctgaaatgcgcggcaatttcgccaccggcgtcgtagaacgcttcggcaaaatcaatcacggtaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatacggtttgtgaaaatattcggcattagggtgaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgaggccattgagcacgcgcttgatggtgaaaaaacagatgccttctttgaacagctggtgtacggagtgatcgaacatcaggttcagcttgatgaaatgatttccggccatctcgtcaattggaagcttgaccggattgcaaacgtagaccgcgcgatcctgcgtctggcggtgtatgaaatggtttatactgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcccggtttggcggtcattttaatcggagacgatcccgcttctgtttcatatgtgacaggcaagaaaaaagccgctgaaacaatgggaatgaaatttaaacttgaccgctttgactcaagcttaaccgaggcggagcttttaacagtgattgatcagtataatcaaaatccggaattccacggcattctcgtccagctgccgcttccggatcatatttctgaaaaagccgtaatcgagcggatctctcccgataaggatgttgacggtttccaccctctcaacgtcgggaaaatgctgcttggcgaagatacatttctaccatgcacgccgcacggaattgtcgagttattgaaaaagacgaacgtagatctttccggcaaagaagttgttgtagtcggacgaagcaatattgtcggtaaaccggtcggccagctgctgctgaacgaaaacgcgaccgtcacatattgccattcccgtacgaaaaatatgtctgagcatacgaaaaaagcagatattcttgtggtagcggtcggtaaagcgaatttcatcaaagccgatcaaatcaaagagggcgccattgtcattgatgtcggcgtcaaccgtctcgaaagcggaaaactctgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcaaagacaaagttcgaggcttgcgtttaagcccgaggacggaatgaaggtcatcgtaagaggcggcatttccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggctacgatcggggtcgtcacgtcaccgacgggagcagccgtcagagacgtcattaccacactcaaaagaagatacccccttgtgaaagtcattgtgcttcccgcgctggttcaaggtgaaaatgccagcagatcgattgtgaagcgcattgaagaagccaatgcacaaaaaatgtgtgacgtcctgatcgtcggaaggggagggggctcgatcgaagaattgtgggcatttaacgaagaaagcgtagcccgggcgatttttgcttccgccattccgattatatcagccgtcggacatgaaacggattttacaatcagtgatttcgtcgcggatatccgggcggcaacgccgacaggagcggcagaaattgccgtccccatacgacggacttaatggaacggacaaaaacggcggaagtccggctgacaagagcgatgcagcagcatatcagcaagaaaaaagaacgggttctatcgctccagtcatcctacgcgttccgttttccgaaacgattgtatacccaaaaggaacagcagtttgatcttttgtatcagcagttccaatcacagctcacagggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccccttcaggtgatggagagaggatacagtctggcctataaagataaagagctgatcaaaagcgttgatcaagtggaacaaaatgatacgcttgaagtaaagatgacagacggcgttctgacgtgtgaagtattgcaaaagagaggcgaacgaaaatgacagaaaccaaaaaaagtgaagagctgacatttgaagaggcgatgaaaggccttgaaggcattgtggcaaagcttgaagaaggagacgtgccgcttgagcaggcgattaattattttcaggaagggatggccctttcaaaaatgtgccatgaaaagcttcagcatgtcgaaaagcaaatggactttattttaaaagataacggcgaacttgcacctttcagcgttcaggaggaagacgaaggtgacaaataaactggacgcatttttagcatcgcgcaaaaaactgattgaacagcagctttctttgtatacggaacggcttgcgatgcctgaaatcctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattccttaatccatgatgatcttccttgcatggacgatgatgatctgcgccggggaaagcccacaaaccataaagtcttcggagaagcggcagccgtattggccggagacgggcttctgacagaaagctttaaattgatcacatcccacgtgtctgaggcggtttcagcagaaaaacggctccgtctcgtcgatgagctgatcagcgcggcaggaacggaaggaatggtcggcgggcaggctgccgacatggaagcggaacaaaagcggataacgcttgaggagctggaatccatccacgagcggaaaacggccaagctcctcggtttttctgtgacggcgggcgccattttggcagatgcgccggaggatgaagtcgaaaagctgcgtctgttcagcagccatatcggcatcggatttcaaatcagagatgacatccttgatattgaagggcatgaggagaagatcggcaaaccggtcggctcagacacgtcgaatgaaaagtcaacgtatccgtcgcttttaacgcttgaaggcgcgaaagagaagctggcgtatcatatcagcgaggcgaaacggatcatcagcggcctttctcttcagaaagaactgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggaaatccgcaatttcctcatcacatcgctgtctgcctctggcggccatatcgggccgaacctcggggttgtcgagctgacaattgcgcttcacaaagaatttgacagtccgaaagataaatttttatgggatgtcggacatcagtcctatgttcataaactgttaaccgggcgcggcaaggagtttgaaaccttgcgccaatataaagggctttgcggtttcccgaagcgcagcgaaagcgaacatgacgtatgggaaacaggccacagctcaacatcgctctcaggcgcgatgggaatggcagccgcccgtgatattaaaggatcgaaagaatatatcatcccgattatcggagacggcgctttaaccggaggaatggcgctcgaagcgctgaaccatatcggtgatgagaaaaaagatatgatcgtcatcctgaatgataatgagatgagcattgcgccgaatgtcggggcaattcattctatgctgggacggcttcgcacggccggcaaatatcaatgggtaaaagacgagcttgaatatttatttaagcgcatcccggccgtcggcggaaaattggccgccacagcggaacggataaaagacagcttaaaatatatgcttgtgtcaggcatgttttttgaagagctgggctttacgtatttaggccctgttgacggtcattcctaccacgaactgtttgaaaacctgcaatacgccaaaaaaacgaaaggtcctgtccttttgcatgtcattacgaaaaagggcaaaggctataaaccggctgagaccgacacaatcggcacatggcacggaacggggccttataaaatcaatacgggtgatttcgtcaagccgaaagccgcggcgccttcatggagcggacttgtcagcggcaccgtgcaggagctggcgcgcgaggatgacagaattgtcgcgattacaccggctatgccggtcggctctaagcttgaaggatttgcgaaagaatttcctgagcgcatgtttgacgtcggaatcgcagaacagcatgcggcgacaatggccgcgggaatggcgcttcagggtatgaagccgtttcttgcgatttattcgacctttttacagcgggcgtacgatcaggtcgtccatgatatctgccgtcaaaacgcgaatgtatttatcggcattgaccgcgccggtttggtcggcgctgacggggagacgcatcaaggcgtctttgacatcgcctttttgcggcatataccgaacctcgttttaatgatgccgaaggatgaaaatgaaggccgccatatggtcaatacagccctttcatacgaggaaggtccgattgcgatgcgcttcccgcgcggaaacgggctcggcgttaagatggataaagagctgaaaaccattccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgaggttcataaagccgattgataaacaaatgatgaaggccattcttaatgaaggtctgccgattttaacgatagaagaagctgtgcttgaaggcggattcggcagcacgattcttgaatacgctcatgacctcggcatgtatcatacaccgattgacagaatgggcatcccagaccggtttattgaacacggcagcgtaaccgccctgcttgaagaaatcggtctcacgaaggctgaggttatgaatcggataaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaaacttgaaaaagccttggaagtgtttcctgtctcggtaaaaggcaaaacgatgattgacatcggctcgtctacaggggattcacggattgcgccctccaaaacggagctgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggcgttcatgctgacgttctccgccgcatgaatcaatttgccgcttctgaaggatatacagtgaaaggactgtccttctcaccgattacagggggagacggcaatattgagtttctgcttcatctggaatggggcggagaagacggaaacggcgctgaactgccggaagaagatattctccgtatcgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaacccaggcgactgtctccagagacattaaagagctgcatctcgtaaaggtgccgacgaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctctgatggataatctcgaatgggaagaaatcatgggcacgatctgcggagatgacacgatcttaatcatctgcaggacgcctgaagatacggaaggcgtacaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggacgcggctcgtccgaatttgtccgttacggtgaaacaaaggccgagcttgaaggactgtttctattggacagcggtcatcccgtttttgaagtatgccgtgagcagggaatagacgcatctgacgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggcgctgaggccgaatccgcgcttcaggcttaccatgaaggctatgagcgttatatggagctgctcaaaaaagtgaagaagctgtcagaaagcgagcaggaaatggcgcatcggttagacctgattcaatttcagcttgaagaaatcgagtcggcgaagcttgaattgaatgaagacgaacttcttcaggaagagcggaagcagatatccaactttgaaaaaatttatgaatcattgcaaaacgcctataatgcgctccgcagcgagcaggggggcttgactgggtcggaatggcctctgcccagcttgaagatatttcggatatcaatgaaccgctgcaaaagctgtctgaaagtgtgtcaagttcctattatctgctggaggatgcaacctttcaaatgcgcaatctgttagatgatctggaatatgacccggaacggctgaattttattgaaacccgtttaaatgagatcaaacagctgaagcgcaaatacggagcgacggtagaagacattttggaatacggctctaaaatagaagaggaaatcgatcaaatcgagaaccgcgacagccaccttgaagccctgaagaaggaattggagtcggtcggcaaagatgtggccgtagaagccgccaatttatcaaaaatcagaaaagcatgggccaagaaactggcggaagcgattcatcaggaattacaaagtctgtatatgggcaaatcaacgtttgatacggaatttctcgtgaaaaccgatccgtcagccagtgaagcaccggttgttaacgggcagcccgtgcagcttacccaaaaggggatcgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggacggacgacaacgcatgtcacgccgctttccaagcaggataaggtagcggaaatcggccgcatgattgcgggtgttgaagtgaccgatctgacaaaacggcatgcacaagagcttttaaaacaggccggacaggtaaaaacgacaggataagctgctgatacaggcagcttattttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccgtttaaagaatatttactgataccgtcagaaatgagcgtctttgaaaaccagacacaggccgttccggtcaatgcatcaataagcgctgaaaagggcgaattatcagaagcctttacgctgaaagaagagcacggtcatgcaaacataacagggcaaacacaaggcaggtcagaagtagtatatgatcttgccggatttcccattaaaaaaacgaaagtgcgtgtccttcctgaattgaaggtcattccgggcggacagtccatcggtgtaaaactgcattcagtcggtgttttggtcgtcggttttcaccaggtgatgacaaaggatgggaaaaagtctccgggagaacaagcgggtattgaatctggcgacatcattattaaaatgaacggacataaaattgaaaaaatgagcgacatcgccccgtttattcaaaaagcgggcaaaaccggtgaatctctggatttattggtgaaacgcgataagcaaaaaatcaaaacaaagctgattccgacaaaggacgaagccgaggggaaatatcgaatcggcctttatatccgtgattcggcagccggcatcggcaccatgacattttttgaaccgaaaacaaaaaaatacggcgcattgggccacgtcatctctgatatggatacaaaaaaaccgattgttgtagaagacggagaaatcgtccgttctactgtaacatcgattgaaaaaggaaaaggcggcaatccaggcgaaaaactggcaaggttttcgtcagaacggaaaacgatcggcgatattaaccgcaacagcccgttcggcatttttgggacactgcatcagccgattaaaaacaacatttccgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtattgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctatggcgttcatatcgaatggatgctgtctgaagcgggtgttgatgtttacgggaaagacaaagcaagctgactgccggatgatccggcagtttttttatgtgatgcgttcttcacttctttccgggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatatagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatcccgatgtgctcgtgttagacattatcatgccgcatctggacggacttgcggttttggagcgtctgcgtgaatcagagcttgagaagcagccgaacgtcatcatgctgacggcattcggtcaggaagacgttacgaaaaaagccgtcgatttaggcgcatcctatttcatcctgaagccgtttgatatggaaaaccttgtcggccatatccgccaggtaagcggaaatgtcagcagtgtcacacaccgtgcgccgtctgcgcaaagcagcattatccgcagccagccggagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaaaccaaccaactcagagttcatcgcgatggttgctgacaagctgagattggagcataaagcttcgtaacgcaagcctttggctaaatgtctttttgcgccttctattccgtgcatgaacgcggaagagaaggcgttttgagattttgctgacgaaaacaatgggaaccactcacgccggtacttgttctatacataaatacgggaactgccgtctatacgtataataccggagctgatattttaatgattttgccgtctctgaaataaaagcgggggatgcggcggcttaacacagaaaggacttcgtagctgatcgtaccgagcatttcggcaatttcatcaacggaaatctcggctccttgttgtttgccgtagatgacgacttcttctccttgtttgccctcattctcacctaaactgaccattatcatatccattgtcactctccccgccaccggcacccgtctgccgcggtgcagaataaacccgcggttggacagggcgcgggagtaaccgtcagcatagccgatcggaatcgtcgcgatgatttcacccggttcggcgatatatgtggcgccataactgacggtccggggatctgtcaccatagctttcacataagcgatacgcgcctttaaacttagtgcgggtgtgagatccacgaggttcagttcctttatcgaggcggacggatataaaccatataacccaatacctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacaggtatgtactcgacttgagcgctttcaccactgctaaaagatcttcttctgtgcgcacacccagccggcccattccggtatccacattgatatgaatggacagccgtttcgactctgcttctttttccaatatccgattcgcttttttgatccagctgacctgaaacgctgataatgtgatgttccaaacggcagattttttcacacagctgagagctgtgaagccgagcacaagaataggcgctttaattcccgctctccgtaacacaattccctcttcgacgctggcgacagcaagctcgctcgccccgctttccagtgcctgccgcgctacttccacagagccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagattcagtactcatgctttcaatctgcattctattcatctttaactgaaatcattcaaaacatgagaaggtgaccgctgatgtttaaaatcaagttttcgggaaagcatgcgcctgctttatttatgcagtaagggcagcatggcggcccttacaatgactttacaatattctgatctgaaaattgatgttcaaacattttggactggcttacagcattgttttgaatgacaatgccgatatttccccctccggcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatatcataatgttttcgttacattttgatcagagtattgagagtttgaagattgagatgtgctggattgattcatttgcaggaccatacctgtatttccccctcctgagccgtagacggtttttgatacggttaaaggacttatcgaaaacgcaccgccgacattgacaaccccgtttccggaaagactgttaatcgtaatagggaaaccagccatcatatacggtctcctttctattaatctatttactatatgtacgctgtgtgttagaaataggagtaaacaaagcggtaaaaacttgtgaatcaaaaaaactgccggacatccggcagttttttagtctacttttcaaacggcacccagccgcctgtattctgaatcatttcccataacggttcaggaagtcggtatttatcaatttcagatgcctgaatggctttttcgatttcctgttcgcggccttctttgaccagcaccgcccattcggggttaatcaaaatgacacgtcccagagccaccagcggaattccgctttctaatacggcaagcgcttcgtccgcggtatagatggaaccgacggccatcagcggcactttatggccgacgcgttcgtttaataaatccatccgggtccgtgaagtatccgcgccgcggcgggctttggaattgacatccatcagtgaaatatgcagataatccaagttctcttccgcaagcgcgtcggcgagcatgaatgtttctttcattgtaagccccggtgtttccggctcttccggtgacaggcggtagccgagaacgaatggattttcagcgtgtgtatcaatcgcctgtttgacagcgtcaacgactgcaagcgggaacgcaaggcgcttttcatcgcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttctgtgagagcacgggacgtttgtctgccgtcttcttctgagccgctcggactgacgacgtcgttgtttggcacgagttcaggagggcattccaagcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgccgtaatgaccatgcccatttcttttgaacggggagtaatgtagcttaattcacggtcggaaatcgttccgtcatcatttgatgaatagtgtgtcatcggtgcgactgaaatacggtttggtatagtgacaccgctttcgaacgtaaaaggttcaaacagcggtttataagtttgcttcatcatttcgccttcttccttaggagtttaactcgtccgtattctagcttatgttttcattgtgtgcaattattttgcttgttcttcttcctgaggttatgaccggctgaaccatttaaacgaatgaaacggttttctccgttccttttcaggatctttatatcctcctgaaatttgatggccgatcgagctgaatatgacagcggcggcgaagaggagaatgatttttttcatatgcatatcttctttcttatcttttacatggttatttataagcatacgcttgtgcgaaaaaaccgtcaatttgtttattcttttttccactttcctgcggcgaatatcgttccgatctgaatcacaacacttaacagagcgcacactgccacaactgtgttgctgtccatagaagacaccctcctttttgttaggttgatgtatcatatgacggctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccgggataacgtcggtcgctaaaatataatacagcagcgcgctcccgagaatcgcgcggtcttcagccggtgttgattcatccatatactgatgatgcatgtttttcaaatggtcaataaaagggccgacgctttcttcattgtccattttcttttgaaactcatcgcaaatcaggcgatggccctgctgggttttggcgtattgttcatatctggtcagttcacgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggaggtgttttgaaaattcctgaagatgctttaaattggccttctgtttgccgttgataatccgggagatagtggccgtatcaatgtttgttaaggcgccgagttttctcatggagagcgagtgcttatcaagcagtgattttaaaaggggtcccagtgtcttatttttattttctgtcaagggtgtcacctcgtttccgccggaatgatgatcgtcaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcaagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgttttaccgggctttcttcctgtattgctggcggcgtttattttatctgtcatcggtatccgcatcattctgctggctgtgccgagaaaaacagcgcgtgttggcgggtcaggaaaaaaaggccgttttgccggtctgctgcaaaatccggaggcagcggatgccgacggttcgggagaaatcggtatattggaatccttggttctcggggtggccgtatccgcaaatgcgctgaccaacggattaagcgcggggttgatcgggctttctcccgctgccatttccattactgcggcggtcggaagctttctgaccatatggatcggctgctcgcttggaaaaaaagccgcttcattgcgcatcggttcttttcacgtcggacagttcagcacggtgctgagcggagtgattattctcatcattgccgccaatacgctgctcttttaagttgtcccgttcattttatgaaaagctcaaaataaatatgaatgtttctattcgggagagtgcatgacgcggctctcttttttgccgatctgatattttttcaaaatgaacagaaagtcgtccgtttccgttaaattctgcatattcggccttcagacagaacctttttcatagactgatcagcttgttttctttctaagttcaggtaaacagcaggtcagatagccttcattccaaagatggaaaaacgctggaggaatggaggctccctttacaaatcggccattctgttcaaagataaagccgaatgagaaaacgtgaggtgatctgtgtgaagtctgccatacttctgatcttcaccgcatggctgttatcaggctgcgagtataccgcggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtcgctgcctgaacatacggcggtgcaaatcacctataaaaaagagagcaacggacaattacggcttgagaaactgaaaaaagaaacagatatgtgaaaacggggaggaaaaaaacgtgggtttactgacaaaaagcgctgctgccttcggtgccgctctgcttctgcttgcgccgtccgcttatgcagccgaacctttgcaagggaaaaccatctatatagatgccggacatggcggagaagacagcggggccggcggaaatggactgcttgagaaaaacatcaatttagcggtgtcaaacaaggtgatcgccaaattggagacagaaggcgcaaaacctgtagcttcaaggactgatgatacttttttacgtttggacgagcgggtggcgaaagcgagcgccagccaatccgatttattcgtcagcctccataccaattcagccgtatcaacggcatcgggcgcggaaacgtattttaattcgacatatgaaggagcggacagcgaaaggcttgcttccgacattcagcagcagcttgtcacgtctttagggatgagggacagaggcgtaaaagaagctcctttttatgttattacatattcaaagatgccgagtgtgctggctgaattaggttttatcacaaatcctcaagatgcggacaagctgaaaagcgataacggacaagagcacgccgcggacgccgttgtaaacggaatcgaaacctattacagcggacggtaatgataaaatatgtgtaaatagcgccctcctgatgtgcataacgattataatagagaaaaccgatgacaaacatctgaggtgacacatatgacgaatatttttgcccaccggggggcgtcgggcgactgccctgaaaatacgatgcccgcattcaaaaaagcgattgaggacggggctgacggaatcgaacttgatgtacagatgacaaaagacggccggatcgtggtcattcacgatgaaaccctcgaccgcacgacatctttgaaaggatttgtgaaagatacggcgtatgacaaaatcagaaccgccgatgccgccggaaaatggaaagattcttttaaaggtgtcagaattccgcttttgtccgatgtgctgcgttttgctgaacgtgctgattttctgataaacattgagctgaaaaacagtgtattccgttacgaaggaatggaagaagaagtgatcaaaaaagtcagatattacggactggaaaagcgcgttattttttcttcatttaatcatgagagtctcgcggtgtgccacgccctggcgcctgaaattgaacgggcggtgctgacaatggatgtgctgtaccggcctgaacgttatcttgccgccattcccgcttcgggttatcatccgaagctcggcacgccggcggtcagcgctgaagtgatcacacatcttgcaaaacaccaagcggcgctccgtccgttcaccgtcaatcgtcctgaggatatgaagcggctgatgaaagcggggatagacgcgatttttacagattatccaaagctggctgtttctataaaagaagaatgccgcagctgagaagactggtcagacagtcttctttttttatgggcgggaaaaaggcggtgcactcataactcggtcagccggttcatatattgtaacagggcgttttgtgtaagcgttatcttttatcttattgaaagtgaggcaaaattgtgggaaaaacggttatcgtcagtgcggcaagaacgccgttcggaaaattcggcggcgcattaaaagaggtgaaggcatccgagcttggcggcattgccataaaagaagcaatcaagcgcgccgctatcagtgaaagcgaagcggaaggagcggtgatggggatggtcgtccaggcgggtgccgggcaaattccggcacggcaggctgcaagatatgccgggcttccgtggtctgttccggctgaaaccattaataaagtctgtgcatcagggctcagagccgttaccatctgtgatcaaatgatccgggcgaaagacgcggacgtgctgattgcaggcggaatggaaagcatgagcaacattccgtacgccattccggccggccgctggggtgtgaggatgggggacggggtttttcaggatttaatggttcatgacgggctgacctgtgcgttcgaccaggtgcatatggctgtccacggaagcactgcggccaaaaagtacggcatttcccgagatgaacaggatcattacgctcttttgagtcagaaacgcgcggctgaggcggctgatgcgggcaaattgcgtgaagaaattgtccccgtcacctggaccggcaaaaagggcaaacagcatatcgttgaagcggatgaggggctgcgtcctgatacaagccttgagcagctcgcagcgctcaagccgattttcacagccgacggaacggttacagccggaaacgctcccggtgtaaatgacggggccggagcatttgtgctgatgtcagaggaaaaagcagcaaagcagcatgtcaggccgctcgcagcgatacttggctttgcgtccgtcggactggaagcgtccgagctggcaagcgcgccgggagaggccatcagccggctcttgaaaaaaaccggactgtccgttgacgatattgatttgtttgaagtaaatgaagcatttgcgtccgtcgtgctcgtgagtgaaaaaatagccgggttcagccgggagaaagtgaatgtaaacggaggggcaatcgcgttcggccacccgatcggcgcaagcggagcgagaatcgtcatgagtttaatatacgaattaaagcgtcgcggaggggggttaggcatagcggctatatgcagcggagcggctcaaggagatgccgtcctgctggaggtgtactgatcaaaggagggagcgccggatgaagatgaaaacaatcatggtcgcaggtgccggtcagatgggggcaggcatcgctcagacggctgcagaagccgggtttgccgtcaagttatacgattgggagccggaaacggtaacaaaaggtcttcaccgcataaagacaaacctggagaaagagcaggcaaaaggacggaagtcacagcaggagacagatgccgttttcagccgtatttccccggcggagctcacagaagcgggagatgctgattttatcattgaagccattgccgaaaacaaaaaagcaaaagcggaattgtttgacacacttgataaaatctgtccccctcatgccgtattggcaagcaatacgtcttctcttcctattacggagcttgccgcggccacaaaaaggcctgaaaaagtaatcggcatgcattttatgaatccggttccggtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagcgattgatgaggtgatgaagctcggcatgcgtcatccgatgggtcctttaacattagctgacttcatcgggctggatacgtgcctttccattatggaggttctctacgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttactgaagagcacatcatgatgaggaaaatggtgcgtgattttgcccgcaaggaaatcgcaccgatggttgagctcatggaatcaacagatgaatttccggagcggctgattaaaaaaatgggcgaagcgggattgatgggcattcccgtcccggaagcttacggcggggcgggtgctgatacaacatcttacattttagcgattcatgaaatatcaaaagtcagcgcggccgtcggcgtcattttgtccgtccacacatcggtagggacaatcccgattttgcatttcgggacagaagcccaaaaacaaacgtatattccgaagctggcagcgggcgaatatattggagcttttgcgcttactgagactcactccggatctgatgcgggaagcctgaaaacaacagccgtgcgaaaaggcggttcatatattctgaacggttcaaaaatctttattacaaacggcggagcggcagatctgtatctgacatttgccgtaaccgatccgggtaaagggagaaagggaatttcagcgtttattgttgaaaaaaacacacccggtttttctgtcggaaaaaaagaaaaaaagctcggattgttaggttccaatactgccgaattgcagtttgatcaagcggaaattccgattgaaaaccggctcggcgaagagggcgagggtttttcaatcgccatgaaaaaccttgacgtcggacggatcggcatagcggctcaggcgctcgggattatcgaagcggcgctcggctgctcggcggagtacgccaaaacccgcagccagttcggcagacccatcgcttcgaatcaggccgtttcatttaaattatctgacatggcaacgaatgcggaagctgccaaattattggtctatcatgcggctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaactatggaatcttattctcccggtttagatggcgtcattgcggtggaaacggggatttctttcctggatacacagcagggcagtattttaatcaaaggccacgatctgattgagctttctaaaacggccggctatatggacattgttcatctcttattggaagacagacttcctgatgcgaaagagaagaaggcgcttgaagaagacgttcggcgcggcggacaccttcccgaggaaatcttgcgtatatgccgtctgctgcccgaacgtactcacccgatggacggactgaggacaggtttgtccgcgcttggaggctttgataaggatattgataaccgcacctcttctgtaaatcggcaccgtgtccgcgggctgataggcaaaatgcccaatctgaccgtcaacagctatcgagtcatcaacggactggagcctttagcgcctgtcggaaccttgtcgtacagcgcaaactttttatatatgattaccggaaaaacgccgtcctccttggaagaagaaatattcgaccggtcgcttcttttatacagtgagcatgaattgccgaactcaacgtttacggcccgtgtcattgcttcgacgcaatcggatatttacggcgctctgaccggagcagtcgcctcgcttaagggaaaccttcacggcggagcgaacgaagcagttatgtacatgcttgaggaagcgaaggatacagacgggtttacacaattattaactcaaaaactcgcaaacaaagaaaaaatcatgggcttcggccaccgtgtctacatgaaaaaaatggacccgagggcgctcatgatgaaagaagcgttgaaaaaactgtctgatctttcaggtgatttccgtctttatcatatgtgtgaagcaggagaaatcgtcatgcgggagaaaaaaggcctttacccgaacttagattactacgcagcgccggtctattacatgctcggcatcccgatcccgctgtatacgcctatattcttcagcgcacggacggtcgggctgtgcgcccacgtcattgaacagcacagccgaaaccggcttttccgcccgcgtgtccgctataccggagcgcgtctgtaaacagatgagaaaggaagatgaaaacatgacagaaccccgccgaatggacgccgtaatcgaagagatttctgactacgtgctccatcaggagattgacagttcggaagctttcactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcctttaatatcggctgtatcaacaggtggctcgattataatgatacgtggcttgcggccgaatgggggcatccgtctgacaatctcggaggcatattggcttgtgcggattatatatccagagtgcggatttcagaagggaaagaaccgcttaccgtgcgtgatgtgctttgcgcaatgatcaaagcgcacgaaattcaaggaattctcgctttggaaaacagtttaaacagagtcgggcttgaccatgtgctgtttgtgaaggtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatatttggcccttatggcgcaaaaaggtgagatggggtacccgacggctctgaccgcatccgggtggggatttcaagacgtattatttaaccggcaggaaatgaagcttgcccgcccgcttgggtcctatgtgatggagaatgttttgtttaaagtatcctatccggctgaattccacgcccagacagcggcggagtgcgcggtccggcttcatccggaggtgaaagaccgcatcgaagacattgacaggatcacgattatgacccatgagtcggcaatccggattatcgataaaaaagggccgcttcacaatccggctgaccgggatcactgcctccagtatattacggcaatcgggctgcttttcggagatatcacggcggatcattatgaagaggaaacggcgtctgacccgcgaattgatacattgcggagcaaaatggaggtgacggaacataaagcgtactcaaaagattacttagacccgaataagcgatccatctcaaatgccgtacaggtgcattttacagacggcacggctacgggacggattgaatgtgaatatccgctcgggcaccggttccgcagaaaagaagccgttccgaagattcttgccaagttttcagcaaacatcagcactcatttttcattgaagcagcagcggaaaatcgaagaggcctgtaaagatagcggccgaatgcagaagctcagcgttagtgaatttatggacttatttctcatataaaataggagggtgacaaacatgacgtggatcgtcagcaagcagtcgtctcaagaggagcttgcagagcggttccgtacgctgatggcagcgccggatctattgcagattccaggcgctcacgatgcgatggccgctcttattgccaagaaaacgggtttttcggctctttatttatcaggcgcggcttacacggcgagcagagggctgcccgatttaggcatcatcacgtcggcggaaatggctgaacgggttaaagatctggtccgctcgtctgatctgcccgtccttgtcgatattgacacgggtttcggaggcgtgctgaatgccgcccggacggcgaaagaaatgtatgaagcgcgcgcggccgccgtccaaatggaggatcagcgcctgccgaaaaaatgcggacatctgaatgggaagcagctcgtgccgattgaagaaatggcgcaaaaaatccaagcggtcaagcgggccgcgccgactcttcttgttgttgcgagaacagacgccagacagcaggaagggctggagggggcattaaaaagggcgtccgcttatataaaagcgggtgctgacgctgtttttccggaagcgctccaatacgaaagtgaattcagagcgttttccaaacaaatcagtgtgccgattctcgcaaatatgactgaattcggacaaacgccgtattacagtgctgatgaattttccgatatgggctgtcagatggtcatttacccggtcacgtcactcagaacggctgccaaggcttttgagcgtattttccgccttctgaaagaagaaggctctcaaaaagaggggctttcggatatgcagacgagaaaagaattatatgaaacgatcgcttacgatgactatgaagaactggatcaatccattgccaaaacgatactgccggacgactgaaaaagcccttttttgcaagggctttttttacagcttttttttcctgaaccgcgggctgacttgattgcgtttccgatctctgtacaaaataaacccggccagaacataaaggccgaacaaaaaaaacgccaatccggccgccccctgaagaaaaagggacggaaacggggaaaacgcatgcccgaataatgcatctctcatcagtttaatgccgagcgccgcgacagcgccggggaggaccagaatcaaaagcgcaacaagccggctcatattcagaaaacccctttacgatatgatttcctttattgtccaatcgaaaaaatattttgtcaagagatcaaaacgtggtaacataggggttgtgcaaattattgcaacgggaaatacaggtgtgcaaattttttcatataaaggggtatcgggatgcagaaggtgctgattataggtgctggtaaaggaggcacggcgctcctacagattttgatgaaaacaaaactgatccggattattgcggtggttgatcaagatccggaggcgcaagggctgcaagaagcccggagatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggatttttaattcaacgcacgacggcatgatttttatagacgtcaacgaaacgatcattttatttaatcagatggcagaaaaaatggtcggccgaaaacgggaggatgtcatcggccgccaaattaaagatgtagtgccgaacacaaagctgccgcggattctggaaacgagagagccggaatataaccagaagcagcttctcggcaagcacctgcagattgtcacgacaagactgccgatcattgatgaaggcggaaaacttctcggcgcgttatgcgtgtttaaagacatcaccgacgcagttgaactggcggaagaggtcacgaacttaaaacaaatccgcaccatgcttgaagcgattattcaatcgtcagacgaggccatttccgtcgttgatgaaaacggcatcggaatgttaatcaacaaagcatatacaaaaatgaccgggctgtcagaaagcgaagtcatcggaaaacccgcttccaccgatatctcagaaggggaaagcatgcacctgaaagtattggggacaaggcggcccgtgcggggtgtgaggatgaaggtcggccccaataaaaaggatgtcatcgtaaatgttgcccccgttattgtggatggtattttaaaaggcagcgtcggcgtcatccacgacgtgtcagaaattaaaacgctgactgctgagctgaatcgggcgcgccagatcatccgcacgcttgaagcgaaatacacgtttgatgacattatcggcacgagtgaacaaatgctggttgcccttgaacaggcgaagctcggggcgaaaacgccggcgacgattctgctgcggggagaatccggcacagggaaagaacttttcgcccacgccatccataatgaaagcgaccgaaaatacaataaattcattcgggtcaattgtgcggccctgtctgaatccctgcttgaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgcaaaagcgatttctgtcaatgtcagaattatcgcagcgacaaacgtcaacatcgaaaaggccatggcggaaggcgcgttccgcgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtacgggagcttgaaaatgttctcggacgggcaatgatatttttagagccgcatatggaacggatcgaacagcagcatctgcctgttttcgaatcagagctgaatgacaaaaacggcacccaaagtgattttccggatgtagaaggggaaaagctgtctcaggctgttgaaaaatttgaagcgcacatcattcaaaaaacgcttgaaaagcataaattcaaccgaaccaaaacggcgaaagcgcttggtgtcagcattcggaatctgtactacaaaatggacaagtacggccttgcaaatgacggcatgcaataaattgcagagaaagcgcaaaccgctgcatgttttcttgaaaaaagccggaataaaccctttcgcatatttggcacagaacttgcattgttaaaagcggattcgcacaagaaaggtggtacaaaatgaagctgagagacctagttgaaaaagccgcggcaaaaaacgcaaaaaccattgcagtggcccacgcagcagataaagaagtgatccacgccgtcaaaatggcggcagaacacttgtcggcacgatttttactgacgggtgacagcggaaagctgaaagagcttctggcaaatgagccgaagttcaatgctgacatcatccacgccgattcaccagaagaatctgcggcaaaagcagtgcgcgcagtgcgtgaacaagaggcggacgttttaatgaaagggaatctcccgagctcaactcttctgaaatcggttttaaaccgccaggaagggcttcgttcaaaaagggtgttatcacatgtagccgtttttgaagtgccggactatgaccggctgatgtatgtgactgattcagcgctgaacattgccccgtctcttgaagagctcgggcatattctgcaaaatgcggttcatgtcgcacattcagtagggaaccctatgccgaaagccgcagtccttgcggctattgaaacggttaatccgaaaatggaggcgacgctgaacgcggctgcgatcgtccagatgtgcaatagaggacagattaccggctgcattgcggacggaccgcttgctttggataatgccgtatcccaagcggctgcgctgcaaaaagggatttccggaagcgtagcgggccaggcggatattctcttggttccttcaatcgaggccggaaatatgctttataagtcaatgatttattttgcgaaagcaaatgttgctgctgtcatcgccggtgcaaaagcgccgattgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccctgcactcggcggaacaagaatgtggacatatgacagtgaggaagcggcgattgaagatgcactgagactcgcaaaaggcatgacttataaaaatgcggctgccggtttaaacttaggcggcgggaaaaccgttattatcggagacccgcgcaaagataaaaatgaagaaatgttccgcgcgttcggccgctacatccaaggcttaaacggaaggtatattacggcggaagacgtcggcaccaccgttgaagatatggacatcattcatgatgaaacagactatgtaaccggaatttctccggcattcggttcatcaggaaatccgtctccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaaccgatatcaataaagaatctgttaaacgtgccgttgaggacttcggcgcccgcgccgttgatcccggcgacatttactcacaggcgtgcgatatttatgccccgtgtgctctcggcgccgtcattaacgatgacacgattaaacagctgaaggcgaaagtcattgcgggggcggccaataaccagctgaaagaaacacgtcacggcgataccattcatgaaatgggaatcgtgtacgctccggattatgtcatcaatgcaggcggcgtcatcaatgtggccgatgagctttacggctacaacgctgagcgtgctttgaaaaaggttgagggcatctatgcaaacattgagcgggtgctcgatatttccgcgcgtgacggcattccgacatacttagcggccgaccgtctggctgaggaacgaattgagcgcatgcgccgttcaagaagccagtttctgcaaaacggccaaagtatattaagcagacgataggaatttgatctggaggtatgaaaatgttcgaacaggaaaaacgcattctcattctgaatccaggctcaacatcaacgaaaatcggtgtctttcacaatgaacgctgtatctttgaaaagacgctgcggcatcccgaagaagagctgaaagcatttaacggcattatcgaccaatacgaatttcgaaaaataagcattcttgagtctttgcacgaacagggcatcaacatttcaaagtttgatgccgtttgtgccaggggcggcctgctcagaccgattgagggcggcacatatgaagtgaatgacgccatgatcactgatttgaaaaacggctacaacggccagcatgcttctaatctgggcggaattattgccagggaaatagcagacggattaaatatccccgcgtatatcgtcgatccggtcgtggtggatgagatgactccgctcgctaaagtatcaggaatgcctgaaatcaagcggaaaagcatttttcatgctttgaaccaaaaagctgttgcccgtcatgcggcggcgtccctcggcaaacggtatgaacagatgaagatgatcgtcactcatatgggcggcggcatcacagtcggggtccatgattgcggacgggtgacggatgtcaacaacgggcttcacggagaagggcccttcagcccggagcgtgcgggaaccgttcctgcgggtgatttggtggagatgtgtttttccggcaagtattcaaaagccgatatgatgaaaaaacttgtcggcacgggcggactctccggctacctggggacaactgacgcggtgaaggtggaaaaacgcattcaggccggagatgagcatgcgaggctcatttatgacgccatggcttatcaagtagcaaaagaaatcggggcggcaagcgccgtattaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggcgaggagcagtcaaagcaatatcagatcggcgaaggagtgaaaacaaatggcgactgaatatgatgtggtcattctgggcggcggcacgggcggttatgtagccgccatcagagcggcccagctcggcttaaaaacggccgttgtagaaaaagaaaagctcggcggaacatgcctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctcttcccggtacggtttccgtcgaatacgcaaatggtgaagaaaacgacatgctgataccgaaacaattgattatcgcaaccggttcaaggccgaaaatgctgccgggtttagaagcagacggtacatatattctgacatcagatgaagcgcttgagcttgagcgtctgccccaatccatgttgatcgtcggcggcggtgtcatcggaattgaatgggcatccatgctgaacgatttcggcgtcaatatcactgtgattgaatatgcggaccgcattttgccgactgaagaccatgatatttcaagcgagatggaaaaactgttaacgaaaaaaggaattaagattgtaacgggtgcgaaagtgcttccggatacattggaaaaagcggatggcgtttcaattgccgctgaaaagaatggaaaaaaagaaacgtatcacgccgaacaaatgcttgtttccatcggccgccagccgaacattgaagggatcggtcttgaaaacacggacattgcagcggaaaacggttctatcatagtaaatgaagccggacagacgaaggaatcgcatatttatgcgatcggtgatgtcgtcggcggtctgcagcttgcgcatgtggcctcccgtgaaggcatcattgccgttgagcatatggcgggtcttaatccggctccgcttgatgccgctcttgtgccgaaatgcatttattcaaatccggaagcggcgagtgtcggtctgacagaagaagaagctgcccgaaaaggacatgaacttaagatcggaaagtttccgttcatggcaatcggaaaggctcttgtatacggagaaagcgatggctttgtcaaaatcgtcgccgaccggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaagcgattggggaagctgcgttagccgcagacggaaacgcgattcatttttaaaaggaaagaaggaggggtttgaatgactacaaaccgccatcaagcattagggctttctgacgaagaagccgttgaaatgtatagaaccatgctgttagccagaaaaatcgacgaaagaatgtggctcttaaaccgctcgggcaaaattccgttcgttatttcatgtcaagggcaggaagcggctcaagtaggcgcggcctatgccctaaaccgcgataccgactatgtgcttccgtactacagagatatgggggttgtgcttgcattcggtatgactgctaaggatttgatgatgtcgggttttgcgaaagcggctgatccgaactcaggcggaaggcagatgccgggccacttcgggcaaaaggaaaacagaatcgtaacgggctcatcccctgtgacgacgcaggttccccacgcggtcggaatcgcgcttgcgggacgcatggataaaaaggatatcgtctctttcgttacctttggagaaggttcttccaaccagggagattttcacgaaggggcaaactttgccgccgtgtataaattgccggtcattttcatgtgtgaaaataataagtatgccatttccgttccgtatgacaaacaggtggcgtgcgaaaatatttccgaccgggcggcaggctacggcatgccgggagtcacagttgacggaaacgacctgctggaagtttaccgggccgtgaaagaagcgcgcgaacgggcatctaaaggcgaaggtcctacattaatagaaacggtttcctaccggttgacgccgcattccagtgatgacgacgacagcagctacagagaacgcgaagaagtagaagaagcaaagaaacaggatccgcttcttttatacaaagcatacttgcaagaagccgggcttctaggtgaagaagaagaaaaggccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagctatgaaagaagaaatggaaagagatccgcgcgtttttgtcctcggggaagacgtcgggagaaaaggcggcgtatttaaagccacggcgggtctctatgaacagttcggagaagagcgggtgatggatacgccgcttgcggaatcagcgattgcgggtgtcggaatcggcgccgcgatgtacggcatgcgcccgattgccgagatgcagtttgccgatttcattctgcctgcggtcaaccaaatcatttcagaagcggccaaaatacgctaccgttcaaacaatgattggagctgtccgatggtcatcagagcgccttacgggggcggcgtgcacggcgcgttgtatcattcccaatctgtggaggccatttttgccaaccagccgggtcttaaaattgtcatgccttcaactccttatgacgcaaaagggctgttgaaagccgcagtccgtgacgaagatcccgtgctgtttttcgaacataagagggcgtaccgcctgattaaaggagaagtccctgctgatgattacgtccttccgatcggaaaggcggatgtaaaacgcgaaggcagcgacattactgtcattacgtacggattatgcgtccatttcgctctgcaggctgccgagcgtcttgaaaaagacggaatttccgcgcacgtattagacttgcgtacggtttatccgttagataaagaggctatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggccctgatgttccggcaatgccttatgcgccgacaatggaaaaatacttcatgatgaatcctgacaaagcggaagccgcgatgagagaattagcggagttttaaagacgtaaggaggtttttgacatggcgattgaacaaatggctatgcctcagctcggagagagcgtgacggaagggacgatcagcaaatggctggtatccccggtgatcaagtgaataaatatgaccccatcgcggaggtcatgacggataaagtgaatgcggaggtgccgtcttcttttaccggtacgattacagaacttgtaggagaagaaggccagactcttacagtcggcgagatcatctgcaaaattgaaacggaagaaacggaaaccgaagaggcgccgaagcgggaagaagagcagaataccccttcagacaccgatgcaaaccgtcaaggtaaagaccagtcaaataaagcgcgttattcgccggccgtgctcagattagcgggagaacacggcattcagcttgaagaagttgaaggaacgggcgcaggaggaagaattacgcgaaaagacattcaaaagatcattgattcgggaatgcagcagaagtcggaagcaccggcgccggctgccgttcaaacaacgcaacaagcgccgaaacaacagcaaaaacaagcgccggcgccagttctgtcagccggtgatattgaaattccggttacaggcgtcagaaaagccatcgccgccaatatgcataaaagcaaaacagaaattccgcacgcctggacgatgatggaagtcgacgtcacgaacatgacggcgtacagaaacagcataaaagactcatttaaacaaaaagaaggcttcaatttaacatttttcgctttctttgtaaaagcggcggcgcaggctctcaaagagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttaccgcggaagatatgcagggcggcacatttaccgtcaataacacgggatctttcgggtcagttcaatctatgggcattatcaaccatccgcaggcggcgattcttcaggtagaatctatcgtcaaacgtccggttgtcatgaataacgggatgatcgcagtgcgtgatatggttaatctttgcctgtctttagatcacagagtgctcgacgggctcgtatgcggccgtttcctcggacgcgtcaaagaaatcttagaaaacattgacgaaaatacttcagtctattaaaaaaactccttttgcccgggcggcaaaaggagtttttttattttcattgtgaatcctcgggaacaagcatagtgagatgatgttttttcacttcgatcgtacaaggcgttgttccgtatacctcgccatctgtatccgcgtccatttcacgtccggtttcgatttcaatcctggaggcctgaatataggacagctcccctttgaaatcatcaaacgaaccctgctccatcgtcatcagctcccgcaacgcggcaaggcttgtgttgcggcagattaacacatcggctaagccgtcccggaggctcgcatcaggcaggggaactctgtttgtcccgatataatgcccgttcatgacaagcaccattacggcttcgtcttctttcacctcgccgtcaattgtcaatttgacaggaaacgggttcgcacttgtcatcgtccgcaaggcgctcgtgaagtagctgattttaccaagccatgctttttcagtttcattgatatggctcgatgcttcggtgatcaatccgatgccccagaagttcagaaaatagccgtcatccgttttacagacgtcaatcatccgtttatgtccggccgcgagcgcttcagcggccttttgaaggttttgcgggatgccgagcgcccgtgagaaatcgttgcacgttcctcccggcaaaatgccgacagcgggcctgttatcaagcttgctgatgctgttgatgcattgatgcacagtgccgtctccgcctaaaatatataaatggtcaactgaactgtcgaggttttcacaatactgacgggcatcgtcctgatgtttggtcggtttaatcaaaagttcgtcagctgactgggccaaaatggggacgaccgtgccgagcgttttatcaatctgtttttgaccggcgtttccgttataaattaatactgctttccgttggctcatacgactgctcctttatttcagacaatctctttaacaagtttcccgtttttaaaaggtcataaacttacatcaggtacataaaaggaacaaaaaacaatttggatatgagcggtgtcatttgccgatagtgaggttccttgctatcataagaaaagatgatcaaaaaggagaggtcccagttgaatatggattttaatttatttatgaatgatgtcgtgcgtcaagcccgccaggaaatcacggccgccgggtatacagagctgaaaaccgctgaggaagtggacgaagcgctttcgaaaaaaggaaccacactcgtcatggtcaactctgtgtgcggatgcgcaggcggtattgcacggcctgccgcataccattctgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccgagcgcttccggggttttttatatggaatctgtataaatataaatatttatacaccggcgttcagctgtcactaatcggaaaaacaatgactataataaacagagaaaggaaaatatatttttcaaaaatagtattgcatcacaattaaaaagtgtttaaaatacaagttaacgaataaatattcaattttaagagatcagtagatatgggggaaatgaatcatgaagaaatggctgttggtattagctgccgcatgtatcacctttgcgctgtccgcctgcggatcaggcaattcaggctcagagggcggaaagaataagctgattatgggtacatcggctgactataaaccatttgaatataaagacggcgatcagatcaccgggtttgacgttgatctggcaaaagctctgggcaaaaagaccggctatgacgttgaggtgcaggacatggacttcaacagcctgattacagccttgaagtccaagcaggtagatatgattttatctggaatgacacctacgccggaacggaaaaagcaagttgatttttctgatatttattatactgctaacaatatgattgttacgaaaaagggaagcagcattaaatccctgaatgatctgaaaggcaaaaccgtcggtgttcagctcggctccattcaagaggaaaaaggcaagaagctcgcttcgaaatacggttttcagctcgaagaccgcaaccggatctcagacttaacggaagagattaaatccgggcgttttgatgccgcgattatcgaagacatcgtagcacaaggctatttcagttcaaataacgatctgcagggctttgcgtcagcagatgcgaaatcagacgaatcgggctccgcgattgcgttccgcaaagacagtgatctgacagcgaagtttaacaaagcgctgaaagaaatggagaaaaacggagaaatcgaaaaactgaagaaaaaatggttcaccaacgagaaataaaaggaagctcaacttttcgttgagctttttatcttgaataaagacaaaggagatcacacgtatgaatttggatttctcagcgacaatcccccaaattccttttatattggaaggccttgcggtcacattaaaaattgtgctcgtttcagcggtcatcggtcttgtattaggaatcgtgctcagcttatttaaaatcagcacgatcagtccgctgaaatggattgcggatttttatacttcgatattccgcggcacgccgcttgtgctgcagctgatgatcatctatttcggtatgccgcagcttctcggctttcagatcgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttgacgaaagaatcggcaatcgtcacggtaatcggtctcggcgatattatgagacgggcctaccagtccggcgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgccgtcatcggcccttccggttccggcaaatcaacgtttctgcgctgcttaaatctgctggaaaccccgagcggcggaacgattgccattaaagaaaacgaaatcaccgcagctaaaacgaataaactgaaagtgcgggaaaatatcggcatggtatttcagcattttcatctgtttcctcataaaacggtgcttgaaaatatcacatacgcgccggtcagcgtgaagaaagagtctaaaaaggatgcggaggaaaaggcgtgcgctctccttgaaaaagtcgggctgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacaatggtgatcgtaacgcacgaaatgggatttgccaaagaagtcgcagaccgcgtattatttatggatgaagggacgatcgtggaagacggtcagccggaagaattttttctttctccgaagtcaaaaagagcacaggactttttagaaaaaatattataaaatataactgtaagaaaagaagaagaatgctcttcttcttttttttgagaaagaaacaaacagaatggagcaagcaatgtttaaaatcggttaccggacactaaagaccgcacttggaacggcgctggccatttatttagcccagctgttgcatctgcaaaacttcgcatccgcaggaatcatcaccatattgtgcatccagattacacaaaagcggtcgcttcaggcctcgtgggcccgatttgccgcctgtttattggcgatcgtcttttcatatgtctttttcggactgatcggctattatccgtttgcgatcggaatattgctggtgctgttcattccgactacagtcgttttaaaaataaatgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcagcgtacaggaaaaaaatcgaggacaacttttccgtcatcttcgccgaaatcgaacggtatttgttaactggtgagcaagattggacagggaaggaaataccggagacgcatcagatgattcaagaggcgaaaaacctcgcctatcgggacgtgcagaatcatattttgcgccatgaaaatctctactatcattattttaagatgaggcagaaacaatttgaaatcattgaacggctgctgccgaagattacctctatttcaataacggtggagcagggaaaaataatcgcccatttcatccatgaattaagggaagccattcatcccggcaataccgctcataaatttttaaaaagacttgcagaaatgagaacggaatttgaagaaatgccgctcccggcaacgcgtgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgtcctgctgctgtctccgctttggccgcttggcgcgaaccctttgccgggtgacccttatattatcgtcaataaagccacaaatgcgcttgctgttgtaaaggataaccgaatagaaggcatttatcaggtggcgacgggaaaaacggatgatttgacgcctgaaggagaatttacggtaacggtcaaagccgtcaatccgtattaccggaagaaaaatgtagagggaggcgcgccggaaaacccgctcggcgtccgctggatcggttttgatgcgaaaggcaccgacggcagaatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggacattgcaatagagcggaaagccctcataaaaaagcaggaaacccccttgcaatgaggcgcctgcttttttactgcaaatacatcataatgcctgagaggagggttgaaagtataaatacgcccaaaatgacgatgacggcgcttttcataaatttttgagacattgtttcactccttaagattactgtctaccattttaacgtgttttgcttatatgaacaagccatatcctatgggggaaagcaggtggccgcgctatgaaaaaacttgatcatgtcggcattgccgtcagctctattgaagccgcgagaggattttacgaacggatgctcgggcttacgtatatgggagacgagctggtaaacggccaaaatgtgagagttgcttttttagaagcgggaggcacaaagcttgagctgattgagccgctgtcggacgcgtctcccgtcagctcttttttacagaaaagaggcgaagggctgcatcatttggcattccgctgcgccgatatgaaggaaacgatcaaggagcttgaatcatgccgcatgaccttgcttcatcatgaaccgcaaaacggagcgggcgggaagaagatcgcatttctctctccaaaagaggcgaacggcgtcctgattgagctttgtgaaacaattgaaaaaggagaaactcaagatgaacatgagtgatcatatcagacacttaaacgaaagacgttcctttttaacaaacggcggcggagcggaaaaaaataaaaaacagcacaaaaaaggcaagctgacggcaagagaaagaattgactatctattggacgaagacagtttttcagagctgcagccgtttgccaaaagccgcacgcccgggtgccagaatgctccgggagacggcgttgttaccggatacggcacaattgacggacggcccgtgtatttgtttgcccatgactttaccgtactcggcgggacgctcggcgagacgcatgcggaaaaaatcgcggcggtaatggatctggcggcgaaaaacaaaaacccgatcatcgggctgaacgactcaggtggtgcgagaattcaagagggtgtggtatcattaaatggatacggtcatatctttaggcgcaacgtcctttactcgggagtgattccgcaaatttctgtcattcttgggccgtgtgccggcggtgctgtttattcacccgctttgacggattttgtgattatggcggaacatacgtcgcacatgtttattacaggtccgaaagtcattgaacaggtgacgggtgaacagattgacgcggaaagtttaggcggtgcgggaatacataatgtgataagcggaaatgcccactattccgcacgaacggaaaaagaggcactttcggctgtgaaaaccctgctttcttatctcccgcacggcggacagacggcactacccgttaaaaaggaagacgccagaccgttattaaacaccctcgttcccgcggacagttcgaaaccttacgatgtgttacaggtaataaaagagctggcggatgacggaacgttttttgacattcagccgtattttgccaaaaacattgctgtcggttttctgaaactcggacggcgtacagtcggtgttgtcgcaaaccagccgaaacacttggcggggagcctcacgattgatgccgctgacaaagcgtcgagattcatccgtttttgcgacgcgtttcatattccgctattgacgatcgctgatgttccgggatttcttccgggccttcagcaggaacatgcgggaatcatccgtcacggagcaaaattgctgtatgcttttgccgaagcggcggtgccgaaagtgacgctcatcatcagaaaagcttacggaggcgcttatgtcgccatgaattcgaaagggctcggagcagatcttgtattcgcctggcccaatgcggaaatcgccgtgatgggagcggaaggcgcggcgtcgattttatacagcagagacatacaggcttctggggacccggagaaaacgaagcgcgaaaaaaaagccatatacgaaaaggaaaacgccggtccgtataaagcggctgcctgcggtatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttattttacatcccacatggacacggttgttccgggcaaaggcgttaagccgattgtggaagacggctatgtaaaatccgacggcacgacgattctcggcgctgatgataagacgggccttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcgccgacacaagcgaaagtgagagcaaccattttcgggaaaacggctcatgcgggtgtagaaccggaaaaaggcatctccgcgattacaatcgcatcaaaagcaatctctaaaatgccgctcggccgtattgataaagaaacaacggctaatatcggccgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagatgggaggccgcgcggaagtggacatcgcggtcatgtatccgggtttcaaatatcaggacggcgatcaggttgtggaagtcgcgaaaaaagcggcggcaaaaatcggccgtccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcagaaatggtcgttgccattatcgaaacagcggccaactaaaaacgaagcacccagttgattgggtgcttttttcattcttcatgatattaggcttaaagctttgcagatacaagaaaaaaccctgccggataggttccggcagggtttcagtattatgatttggcgggctccgcctgagccgcagcctgtttctttttatgatgcgtctgctgtaaaagtacgttctgcactgtcaaaaacagtccgcttgtaaaccagtaaagcggcagcgcagccggtacgttaagcgaaaaaacggtcatcatgacagggaaaataaagaccatgatttttgctgactgcatcgcggccggattttgagcagccggtgaatatttctcgtttaatttttgggaaatataagcctgtaagaaatacatggccccgcgcacagtgatacaagaatatcagaatgccctaagctgaaccacagaaatgagtgtgaagcaatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttttccgcatctttcgtttgtttcattttagcctgaatgctgtcgacctgcggtttgatcacagccattttttcctggaacacccgctgtttcttaaattggttcacaaacaaaggcaatacaacgatccggacgataatcgtcaccagaataatcgacagtccgtactcaccgtggaacaggcccgccaccccttttaaaagtgccgaaaacggctcgatcaggtaatcgtggaaaaaaccgatattcccgaggcctcccgtctgagtctgagatgtcgccgcaaaagccgagcggcctgtgcacagtacgataaaaaataatcccaatacgatccacttttgatatgttttagacaattatgtttcctcctttatatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagcgggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctacgaagcgagagcgcggggcgtaaagaccaccatgccggtgtggcgggcaaaacgcctctgtccggaactcatcgtcgtgcctccgaattttgaccgctatcggagttcgtcaaaagaaatgttcagcattctgagggagtatacggatttagtcgagcctgtttctattgatgaaggatacatggatattacggacacaccgcacagacacagggcgtatgagacagccgcagacattcaggcgagactgcaaaaagagcttttgctcccgtcaagcatcggcatcgccccgaataaatttctcgctaaaatggcgtctgacatgaaaaaaccgctcggcatcaccattttaagaaaaagagagctgccggacgtcttatggcctcttccgatagaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatttatgaatttaaaagcgtcggcaactcatccaccctgtcgcatgattcggctgactgggatgaattaacgggcgtgtttgaccggcttgcgctgtctgtgagcgaacggctccagcgtaaggaggtcatggcctgccggctgttcatcatgattcggtatgcggattggaaaacggtcacaagaagcatgaccctcagcaatccggctgatcagaaaaaagacatcatggaagcggcgatggaactgtttgacaagcactggaaccaaaacccggtaaggcttctcggcatcaccgggacggaactggttgaaaaacagcaggcgtataaacagcttgatctgttttcattcaaggaggacgcaaaggatgagccgatttttcagatgatgaacgagctgaatgaaaagtacggccaaaacctgatcagaaaaggcgccgttataaaaaaagaagaaagcaaaacaaggggcacgagctttaacagagacttttttcaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagtttttagaagaggcaaaaggtaaaaatgttgtcggtacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgccggaacaaagagcttgccgaaagcggcattcactttatcggaacgggtgtatcaggcggtgaagagggagcgctgaaagggccttctattatgccgggcggccaaaaggaagcgcacgaactcgtaaaaccgattttagaagccatttctgctaaagtggacggggaagcttgtacgacatacatcggcccggacggagcgggacactatgtgaaaatggtgcacaacggtatcgaatacggtgatatgcagctgatctctgagtcatatttcattttgaaacaggtgctcggattgtctgccgaagagcttcacgaagtattcgctgagtggaacaaaggagagcttgacagctatctgatcgaaatcacggctgatattttcactaaaaaagatgaagaaacgggcaaaccgctagttgacgtcatccttgataaagcaggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcggccttctgtccggaccagacgttaagccggtcactgaaaataaagaagagctgattgaagcggtcagaaaagcgctcttcatgagtaaaatctgttcttacgcacaaggcttcgctcaaatgaaagccgcgtctgaagaatataactgggatctgaaatacggtgaaatcgcgatgatcttccgcggcggctgtatcatccgcgcggcgttcctgcaaaagatcaaagacgcatatgaccgtgaaccggagcttgacaacctgctgttagacagctacttcaaaaacattgcagaaagctaccaaggcgctcttcgccaagtgatttcacttgccgtagcccaaggcgtgccggtaccttcgttctcaagcgcacttgcgtattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcattgattgcgggggcttttctgatattaaaaaccgcgggccgtcatgaacggcgccgcggtttttaaattttttcttatatattccaccagtggagaccgtctttttcaagaagatcgtccgaagctttcggtcccattgaccctgcttcataattcggagaaagggttttgtcggctgcccacgtttcggaaatcgcatcgacgaaattccaggaaagcgccacttcgtcccaatgggcaaagtttgtcgcatcaccgagcagacagtcatggattaatttttcataggcttccggtgtgttcatttcatcactgcagttgctgcagtagtccagcttaatcggctgagcatgagcggctccgcctaattttttagcgttcagatatagtgtgatgccttcatccggctgaatatggatgacaagcaggttcggatttacattcgtttcattgccgtaataaaggttcatcggaatgtctttaaattgaacgacgattttcgttgatttttctttcatccgtttccctgttcggatataaaacggaacgccggcccagcggaagttatcgattaacagctttccggacacgaatgtttccgtattggaatccggtgctacattatgctcatctgtatagcttggtacagagtttccgtcaatcgttcccgcttggtattgtccgcggacgaagtagtcactcacttcgtttggagcgacagggcggagagctctcagcaccttcactttttcgctgcggatttcttccgtgttcagtttaatcggcggttccatcgccaagagagcgaccatttgcaaaatatggttttggaccatatcacggagtgcgcctgatttttcataatatctcgcgcggtcttcaacgccgagatcctcgcttgacgtaatctggatgtttgagatgtagcggttattccacagcggctcaaacagcgcattcgcaaaccggatgacttcgatattttgaaccatttgtttgcctaaataatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaaccgtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcattgaaagcaaacatttcagcctgttttttgcggtttgcggaaaaaaattaatcaggccggagaaggcccgggtgaattcacattttcagtctgatcctgtatccttagtagtacaaagatctaggaggaagcattgtggaattattatttttagggacgggggccggcatgccggcaaagacgagaaacgtaacgtccgtcgcgctgaagcttcttgaagaaaggcgttccgtatggctgtttgattgcggagaagccactcagcatcagatattacatacaacaatcaaaccgaggaaaatagaaaagattttcatcacccaccttcacggcgaccatgtttacggtcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcacttcattgttaccgcagcatccgtcattcacggtgtggaagcgttcggctaccgggttcaggaaaaggatattcccggcgcattgcaggccggcagattgaaagaaatgaatatcccgcccggacccgtctatcagaaactcaaaaaaggcgaaacggtcacacttgacgatggcagaatcattaatgggcgggattttctggaatccccgaaaaaagggagaatcgtcgctttttccggggatacgagggcatcagagcgggtaacggagcttgcgcgcaatgcggatgtgcttgttcatgaagcgacgtttgccaaggaagatgcaaagctcgcacataattattatcacgcgacgacagaacaggctgcgcaaacggcaaaaaaagcaggcgccaaacagctgatcttaactcatatcagcgcaaggtatcagggtgaatcgccgatagagcgtctcgaacatgaggcgaaagcggtatttgaaaacagtaagatcgcatttgacttcatggaggtcactgtggagcggtcttaaaaaatagacgcttgacatttttttctgatgatatataataaaacgtaataattacgatttaaaaaaggggtgaaaatgatgcgtgtgaatgttacattggcctgtacagagacaggggacagaaattatatcacgacgaagaacaaacggacgaatccggaccggttagaaatgaaaaagtattcaccccggttgaaaaagtatactttgcatcgtgagaccaaatagatcacgataacaaaagccattgtgccgttgcacaatggcttttgttttcatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaaatgaatctgctgatgctggatctgcctaaggctcgttaaaaattctgcgtgtgatccttccaatttgaactgtttcaaataggcggccttcatttcttcaggaagaagcggaagcactttcgtctcctgatcctcagaaaccggatcaagcagcaccatcccgagaatatcccggcggttccggctcgcccaaagtctgctgataatcgtgccgtatgaatgcgagacgacaaggtaaggaggcttgacgccggccttcagaagaagagcgcttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatctcctctaattggttctatagggaagacggagaagcttcggcaatcgtttctcgaaaaataaaaaaagagacagccgggatcgaaaaactccggctgtcacttcatcaccatgctctgtcgtattggaccggtgacggtatttcagtattcagctgcttcgctgcactccttgcaaagtgcggatcgcggagaagttctctcgcgacaaaaataaggtcagcgcggttgttgtgcagaatttcttcggccattgttcccgtcgttatcaaaccgacggcgcctgttgcaatttcggcctgttcacggattttctccgcgaagctcacttggtagccggggaagacgttaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacggcttcaatggtctcgcctaagaagcggtagcgattttcatgtgagcctccgtattcgtctgtacggtgattggacagaggggacaaaaattcgtgcattaagtagccgtgtgcggcatgaagttcaatgatgtcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccagatgcccaaatcctgatcggaaatgcgcccctgaggattaacggctgtcgcttccacgataatcaggccgacctgtccgattgcacgcgatatgtagtgcgccatatgaaaaggctgcagttttccgtccttctcatgtgaggaatacatacacatcggtgccataacaatacggtttttgatcgttacatctttaacggtccatggtgtgaataattttctcgccatttatttcgcctcccggaatgtttttcgacattgattataacaactcatgatcattcagtcatataaactgctcacaactgaacagatcgttcttattgttctggacgggcatttttttatacacagcgtggccgtatcttcataacaggcatttacagccgatcatatagcaaatatagatgagaaacgcaccgatgactgcgtggcctcctttgatccagtttgtcaggatgaaaatactgctgatgaagatcactgcgccgaaggcaccgaatattccgtttttttgagcggctctgaaatcgtcggggctcatatttttcagctgcaagtgaatattcagtaacgacatgatcggcagcaatgtgataacgcctgataaaaataagtatttcgacttgcttaaatacgcggcggccaccataacggtgccgccgataaaaaattgaatgagaaaactcatgctgaaacgctcaccttctgtttgttatcaagtataatgatggagacattgccattttatttttgattgatgtataagtaaactaaatataactaatgcattggataataaagaatgatatctgggagatgaagccgattggatttaaagaagcatttagcctttattaaaacggtagaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttctattaaggtgcatttatttgatggaaattctactgagctggaacaatggctgaaagatgaccggattgatgcggcgattgggacatcccacagcgagaagtggcatttttacccgttggccgaggacccgattgtagcggtgatgagcccgcagcatgaattggcgcaatatgaaacggttccgttacatgtcatggagtccgtcaaatgtatcgtgccttatccggagacacattttgatgtgctgaaagtgttaaaggaagaaaagatcactccgcgggttgcttatcaaatcagaggggatgaagcgattattgcaatggtgcggaataatctggggatcagcatcttgccgcagcttttggtgaatgatggtgatgtgctcatcaaacggttcgaccggtatgtctccaggcagctcggcattttgacagctcgtgcaaaggagacgcagacaccttctgtccagaaactgattcaatgcatacaagaatgggttgcggtccatcaggcttctgcctgaagaagcctgatatgcgtttaagccggttcaggataatagaccagcaataaatatgtcatcggttccgaggaatgaaaataactgtgcggcatcgcccgaagtcagcacatgcttttcgtcatgaagctcaaccgtcaattcaccgctcttgattaaaatgattcccctaaatgtgattttgtctcataggcgcagcccggcttcaggtcaactatgccttgaaaacaaaaatttgaccgtgacggtggtgagcggggttattttgatgtcgggctttcgtctgtttatataaaaagggcatcaacggcacatgctgttgatgctttttttgaaatgctagggtttggagagcacttcaattccgacgttgaccattttgtccagccccataaaagacaggcagattttggcgcgtctttttcttttatcgatttttttaataatgccttccattcctttaagaggccctgaggcaacggttacttttgaattttcaatatagacttttgaataatctacagtgtctccttctccgatcagcctgataatagggaggatttcttcatccttaattgtcgtgaaataggttttgcgctctttggaataatatgctccgttattcacgattctgcatgaaatggggagttctttgattttatgaaatgtccgctctgtcatctttgttttaaacagaacatatcccggaaacatctttttgagtgcctcgtatttaattccggcttttcgttctgtgacttttttcttgggtatgattgagtagagagcctgctcatcaaactgcagacgcagaaatttttgaactgcttcttcttttcccgactctacaaaaagtgcgtaccatttcatgactggatcctccttagaataataagaaattattatacaaagaaagtatttaatggatagtatttaaagtgattaaaaatttttctaattcgtcttttttttacataatatatgaaaatgaaaaataagtatagacccaattgacagagaggcgatgaattttctttgacatgaaaagggttcagggaattatctgacatttatcccgaaacaattatgccgactgtccaccgaatataaaactgtggaataaatgtcagaaaataacgaaataaagccttgacattattatctataaattgatattattctctttaaatagcaactatttgttaaatttattaaattaaagtaaagcacctattaaatttcaatcgctgtttcggcacgttgaagaggaaatagggattataaaaatgattgcagtgtatatatctacatatacatgataagggagaagtgtgccgtcatggctgttttcgggcatattggcactgcagcttgtcatgcgaaacattcagtaaacaagcaagatgttttaatataaattatgttagaaaaggaaaacacaatgcgtttgcgatttttaaacctgtgctgaatcgcaaacgcgtttgtgtttttatttttatggcggtgtttacaccagtcaatatatgaaataagagacgtttttgtatggagaaccacatgtgatgtacaaaattggcgatggggaaaggatgaggataagatgcttacgtttgtgttcccggggcagggttctcaatttaaaggaatgggagccgggctgtttgatgaatttcaagatctgacacgtcaggctgatgacatattaggctactctatagaagaattgtgcctggaggatccgaatcatcagctggggaaaacgcaatttacccagccggcgttatatacggtaagtgcactcagttatttaaagaagattaaagagtccggcagagagcccgattacgccgcagggcacagtttaggagaatataatgcgttatttgcggccggctgctttgattttaagaccggtttgcagcttgtgaaaaaaagaggggagctcatgagcaaggcagctcccggaggcatggcggcggttttggggtttacggctgaacaagtaaaagaggttctatccgattatcatctgaccggcattgatatcgctaaccacaattcaccttcgcaaattgtgatcgccggaacgaaacaagacattcaaaaagcgggccccgcctttgaaaaagccggcgtgagaatgtatcttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgataggacttgaaaataatgaaattgcagaagtcgggcccggggaagtgctgacaaaactgacgaggcagattaaaaaagatgccgtcccattacctatgccgaaagaagagtctgatactgctgatgttaaagcatcggcagctgattcccaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggaaccatccggtctgcactgcggcaaggggaaacattcggaatgaatcttcttcatcatatgatgtcacctgacaaggaagtcagaatgatagatttatatttaaaaaacggcattcaccttattgaagcatcggcatttatgggcataaccccggctctcgtgatatacagggcaaagggattaagcaggaatcatgacggatcggtgtcagtccaaaacagaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggcgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagataagtatttccagcgcagttttgaggaagtgtatgagcagttgaaacgtgataaatctcctgaacagatcgccaaagccgaacagaatccgaaacacaaaatggcgatggtatttaaatggtatttttcccatacgacgaggctcgctctggaaggaaaaagcgaaagtaaaatagattaccaaattcattgcggccctgcgctcggcgcgtttaatcaatgggtgaaaggaacccctcttgaaaattggagaaacaggcatgtcgacttgatcggcaaacagctcatggaagaaacagccggccttcttgcgcaaaggctggtatcgattacaggctgagtatgaccagacattacattttttctgcggaggactaccatgctgattgaaaatcatgaattaacgatgagccatgtcggattagggaatttgaatgagtacgcgctgctgctgttattcggcaatgcacacagtcaccatttaacggacggaacgggattccggcctgatcagatggccgatcaccaagggctgattttgtatccggcttattttatgacacatctcaaagttccttcagataagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgttgacgtcacacaaacagaaggttcgacgcgcaaagtctcagcgccgaaggctgaatgtattgcggaactttctaagctagccaagccgccttacgcgctgatgcggtcaaagaaagtcagaacggacgctttcggtatgaagccgggaaacctcaaaacagcggaccccgtttcatatcgggttcctgttgatcaggatgctgcgccggggcatgccatggtgtttgcgaaattcagcaagataatggatgcggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaaggaatcatacattgctggccatttccaaggtggataagctgctggcggtgccgacctcttcacaagatcatattccggattataaacgggtcatcagaagtttataaaatgaagaatggagctgaaagcaaatggaacaaaccaaggaaatgaagcagatcatcgctcaaattattcaggatattcaagaacagcagtcatatcgggccgtcgaagcgggagatgatgtgagagtcatagaggatctgggcttctcatcactggatatcgctcaattagtcgcacagatggagatggaaaccggagtggatcctttttcccaaggagaaacgatttccagcattacaaccgtcggcagcatttgtgatatttatcaaaaatacatggacagtgctcaatcatgaaaacagaaagcaggggagatatcagctgggtgactgataagcttagggaaacgcaggacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgaaggttctgaaagcgcctctcaccctctgcttgatgacctgcgcgagaaaggggagtcaggcattattattttcacatcgggaacctccggcaaaagcaaagcatccgtgttaagcgccggccggctgcttgaaaaatacaaaacggcgaagagaaaaccgctgcgtacgctcatttttctgaaattggatcatataggcggcattaatacgctgtttgcgattctgtttaacgggggaacgatcgtcacatcagacagcagaacgccggagtccgtttatcaggcggtcgacaaatatgctgtccaagtgctccccgccacccctacttttttaaacatgctgctgatgtccaaggcggatgccggctataacctgtcttcactccagctgatcacttacggcacagaaccgatgccccaatcaacgctgcgcggcattcaccggctgtttccggatgtacggctgaaacaaacatacggattaactgaactgggtatattctcaacgaaatcaaaagacagccaatccacttggatgaaagtaggcggtgccggaacagagaccaaaattaccggaggcacgctttgggtccgttctgagtcggcgatgctcggctatttaaacgcaccctcacctttcgatgaagacggctggtacgacaccggtgaccaggtggaaacagacggcgaatatataagaattctcggaagaaagagtgaaatcattaatgtgggcggagagaaagtgtttccggcagaggtggaaagcgtctttctggagatacctaatgtccgggatgttctcataacgggccgaaaaaatccgattacaggcgagattgtcgcggcagaggccgtacttgaaaaagaggaagatatcaaatctttcagaaagcgggccgtagctcattgcagacagaagctgcagccatatcagataccgcagatcatctctgttacagatcggaaactgtctaatgaccgatttaaaaaaataagaaacgtataaaacaggaggcaaatatgaataacggaaaagtagcggtcgtcagcggaggtagccgggggctcggaaaagcgattgtacaggcgcttttggatgagaattacaaagtagccgctttcagccgcagtgaatctgattttattaacacattgagagagagtgaaaagtaccgtgaccgcttttattgggaagcggcggatgcggcggatgatgccgccatgaaacagtttgttcttcaagtgtaccgcaagttttccagaatagacggcttggtcaataacgccggtttgaaccttgatcagctgctgcccctgaccaatgatgaagacattgaccgcatcctcaatctgaatatcggttcagtcatcaagctgacccgaaacgtttcccgggtcatgctgaaacaaaattccggatcaatcgttaacataagctccattatcggttcaagaggatttaaaggcacttcagtctacagcgcatccaaagcggctcttgacggcttgacgcgaagcctggccagggagctcgggtccaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgttttctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcggaaaagctgggtgccgaggtgaccgaagcagaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaagtgcttcctgtacaggcggctgaaaaggtgcctgaaccgggaacggacaggagttctgatattgcggttatcggaatgagcgggatgtttccgaaagcggaaaaccagcatgatttttgggacaatttaatggaaaataaagattgtgtctccgaaatccctgaggacagatgggacagctcttattactcggaagagaaaacggcaaaatacgcgtcatacagtaaatggggaggttttattgatcgtccggatcgatttgacccgctgtttttttctgtttccccgtgggaagctgatttaatggaccctcagcaaaaattgtatgtcacgtgctgctgggaagcgatggaggatgccggttacgggaacccggcggcgaggccgacggatcaaatcggtgtattcgccggagtgacctggaatgaatattcattaattgcacacgaagaaggtttcctcaaagatcagtataaaggccccggctccttatattggggcattccgaaccgggtttcttattttcttgatctccatgggccgagcatcgctgttgatacggcgtgttcttcatcgcttgtcgccgtccatcaggcttgtcaggccattatgtcgggcgactgtgaaatggcgcttgccggaggcgtcaacctcagcttacatccgcaaaaatacatgtttttaagccaatcgcattttctgtcttctgaaggaaaatgccgcagcttcggtgaaggcggagacggttacgtgcccggtgaaggcgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctataaacagagccgcggtaagtccggcggatatcagctacattgaagctcacggtaccggcacggcactcggcgatccgattgagatacgcggtctgtctatggcatttgagaaacagaccgatgagaaaaatgactgcggaatcggctcggtgaaatccaatatcggacatttggaagcggctgcagggatcgccggtttaatcaaggtgcttttaagcatgaaacatgaaacgcttcccgccagtctgcacgccgaggaactgaaccgcaagatttctttttctgattcgccattttatgtcgtccgaaacaatcggccgtggccggctgaaggagataaaccgagaatcgccgcaatcagttcattcggcgcaggaggctctaatgcccatctgatcgtaggtgcttatcagccaaaacggcaagcggacgggaatactgagcaaaaaccgcatgccgtcgtactaagcgcacattccgaacagcagctgaaagaatatgccggaaaattgagctcctttcttgcccgattggaaaactcgccttctgccggcggatacagcctggaaaatatcgctgccaccctattgtcaggcagagagcctttctccttccggcttgctgtcattgcgtcatcccttcccgagctgaaacagcgattggacggctttgtgagcgggcacagcggcggcaggcatatttacttcggaaaagcgtcacccggacggccggacgtttcaggccaatccgtttcagatcctgaaaaatttgccgcgctgtgggtcaaaggccttcaaggtttcaaaaagccggagacgccgtatcagaaagttccgcttcctacgtatccgtttttaaaggaaacgtcctggctgaccgaccaaaaaaagcggtatacgaaaaagccccaatctgtcaaaaggcgtgaagcgctgcatccgctgcttgatgagaatgtttcatccgcccggaaagggacgtttcaaaagatattttccaaggatgaatatttctttaaagatcatttagtgaacgaaaaatatgtgctccccggagtctgtcatcttgaaatggcggcatacggcgcggcattgtggggagaacgcccggtcgtctctcttcaaaatgtgtggtatatggagccgattgtgacagggacagacccaagatccgtcatgatagagtttgaagcggaaaaagagcgtataagctatgtcattaaggaaaaaggagcggacggcactctcttttcgcaaggagaagtgatttgtaaagaaaatggagcgtcgtttgaggccccggtctttcagcttccggcgccatttacgcagagaacggagccgaaagacatctatcactcgttctctgaggcgggaatcgtgcaaaaggacagttttcaggtcatccgcgaattctcttatacagaaaggaaagcactggccaaattaacgctcccgtcacacttggaagcggattttaaacagtacatcctgcatccgtccttactggatggcgctgttcaaactgcaatggcgcatgtgctgcaatttcaaaaagagcctgcgcttatcgtaccgttttccttcggagaaatacagctgcttaaaccgttagcgaaaaccgtatttgtgcatgcggaggtaaaagcggcctccgttcaccaatttgatctgcatatttgtgatgagcgcggtgtgctgctggcggcagtgaaagattttatcataaaagaggtgcaggaaagcgccgggtttaaccaaaaagccggcgtcatgccgaagaaaagccgtgaaacggaattgcttatgacaccggtttggaacaccgtcaccattccggaaaccggcatgtctttcatgcgtgaagaaaaaataatcgtcatcgggggcgggccggattttcagcaggctttgaaagagatgtattccgatgtccgttttccggacatcacttctttggacagcgcggaacaaatagctgaaacactgaaagcgcaaggctcttttcaacacatgatatgggcggcgccggatcatccgattccatccgtttatgatgcggatacggccgacggacaggagcacggggtcatgcagcttttccggctggtaaaatcgcttctgcttctgaattttgacacggaacaactatcattgacaatctgcacgtttcaagcacagccgattcatgaacatgatgaggtcaatccgagtcatgcaagcatacacggattagcgggggcgctcgcaaaagaatacagcaattggagcatccggcttcttgatttggaatctcaaaggggagaccggcatcttcccgatatcttctctttaccggcggaccccgagggaaatccgtgggtctttcgtgcaggtcagtggcaccgccagcaattggccgtctgccagcctcatgcaggtgagccttcattataccggcacggcggggtttatgtgattatcggcggagcaggcggaataggagaagtatggactgaatatatgattcagacctatcaggcgaaaattgtctggatcgggagacggaaaaaagatacacagattgaaagaaagctgaaaagacttgcggctttaggtcccgcaccgcaatatttcagcgcggatgctgcggattatgattctctcaagcgggcgtatgacaccattgtgaaggaacatggaaaggtgcgcggaatcattcattccgccatcgtgttatcagaccggagttttgccaatatggaagaggaccagttccgcgcttcactttctgcaaaaactgatgtcagcttgcagattgcccgggtagctgaaggggaaccgctggatttcttgctgtttttctcttcgatgatgtcgtttcaaaaagcgccgggacagagcaattatgccgccgggtgcacgtttaaagacgcttttgctaagcggatctcacaaaaagcgccgtatgccgtaaaggttgtcaattggggcttttggggaagtgtcggcgttgtcgcttcagaacaataccggaaacggatggagcgggacggaatcgcttctattgaggcgcccgaagcgatgaaaacgctggaaaccctgctttcgggaccttatgaccagctggcgctgatcaaaacgacagatccggtttttatgaaagatgatctgaaagaacaagtaacggtttatccggaaaagattccttccgcactcggacaattagcggttaacatcacgcagaatgacgaagctgagcgggtaaaagcatcaaatgtcatgagctgcatgagagagatggaatccctcattgaaaaaatacttgtatcaaccctttatgagatgggcgcaaggcttgatgagactttgccgttatttcaatcggctgccggcataacggaacaatacagcagatggctgaaagagagctttgtcttcctgactgaattagcgcttgctccggaaaaaacggatctaggggaggtgtgggaggaatgggagcggaaaaaagagacttggctgcgccggaaagacatgagggcgcatgtcagattggcagaagagacattgcgtgtgcttccagacattttaaccggtaagcttccggcaacggaagtgatgttccctgactcctccttccgtcttgtggaaggcatttaccgcaataatatcatttctgattttttcaatgacaagcttgctgacacattgattgcagttttgcgggagcgtctggaaaaagacccgcaggcgaaaatccgcattttagaaatcggagccggaacgggcgggacgagcgccgcggtcatgagaaaattgaaaccgtatgaagcgcatattgccgaatattgtttcacagatatttctaaagtatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctacgctgcgccatgcgaaagcaatgctgcaaaaaaacggccagctgtttataaatgagatcaacagccgcaccgtattcaaccatgtgacgttcggccttcttgaaggctggtggctgtatgaggatcatgatttacggattccgggctgtccgggggttgagccggccggctggtcggaagcgctttcacttgaagggttcgtccatcctctgtttccggctgaagccgcacacgacttaggccagcagattatagcggctgaaagtgacggaacggtcaggcttgccctcccgcaggcgtcagaagaaaaaccggagcgccgtccgtatgacgcagatggtctttcggatgatacattgcatttcagcttgagagaaaaaagcgttgaactgatgaagaaggtaatcggtgaagcgcttaaagtgccggcgcatcgtcttttatcccatgaacctttaaccgcatacggattggattccatactggtcgtcagactgaccaacgcgttaaaagacgtcttcggttctgtcagcagcactttgttttttgaatatcaaaccattgatgagcttgctgattactttctgtcttcccgtaaagaagcgctcgagcggcaattcgggaatggacgggctcattccgaaaacgccggacggatgcaggctcccgcagaaagcgccgcgccgattccaaacgtaagggaacggggcatcacatatctgacggaattaataggaaaaacgctaaagattccgagcaggagaatggatccgtcggtttccttaaccgcatacggtttggattctattctggtcgtcaggctcacaaatgcttttcgtaacgtgtttgaccaaatgaccagcaccctcttttttgaatatcagacgatagaagaaatcgcggattacctgcttctttctcagcggagagcatttatgaaagcgatgggtgtgcgtgaggagcagctgtctgatcacacagataacctgaatgtaattcctcaaaacgaggaagaaagcaggacaaacggagatccctatatccaggatatcgctgtcatcggtctgtcaggccggtatccgggcgccgatcacgttgatgagctgtgggaaaatgtaaaagccggcaggcattctattacagaagtgccgaaagatcgctgggactggaaaacgttttataacgaggaacgcggaaaatgggggtccatttattcaaaatggggcggtttcctcgatgacattgataaatttgatccgctgtttttccgtatatctcccgcggaagctgaaaggatggatccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaattttcaagggccgagtatggctgtggatacagcctgttcttcttctttaacagctgtccatctcgctgcagaaagcctgcggagcggaatgagtgaaacagcgattgccggcggagtcaatcttatcgttgatccggctcactatgagcggctgtccgctttttcaatgctgtctcccggtgataaatgcaaatctttcggagacagggcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccgaatccgaaagcgcagtttgatctgatcgcagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttcaattaaatcaaatatcggacatttagaaagcgctgccgggattgcgggaatcaccaaactgcttctccaattgaaacataagaggattgccccttcattgcatgcggcggaattgaatccgaatattgagtttgagcacactccgtttttcgtacagcaaaaagaaacggaatggaaacgacctgtcttgaatatcacgggtgaaatgaaggaatatccgagaattgccggtatttcctcttttggagcaggaggggcaaacgcgcatatcatcattcaggaatatgtgccgtctgacagcctgaaaccaagggaaaacgcgtctgtttctccgcaaaaaccggctgttattattttatcagcgcgaaatgagcagcaattgacagagcgcgcccgccagcttctggatgatgtcataagaaaaaaacgttctgacggggatttggccaaaatcgcttacacgcttcaggcgggaagagaaccgatggctgagcggcttgcatttacggccgagtcgatagaagaactgaaaatgaagcttatgagtttctcaaacgatcatatcgaacatgctcatatctggcggggcaggacagccaaacatcattcattggcggcttcgctcacttctgatgaagatatggcgcttaccataaatgcctggctgaaaaaagggaaatacggaaagctgcttgacctttgggttaaaggacttgacgtcgattggtcagctctttatcagcgcaacccgggccgcatcagtctcccggcttatccttttgccaaagaccgatattgggtcacaaaagctgatgtgtcacttgacaaaacaggctcagcggaaagtgagaaagcagccagacttcacccgctgctccacgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcgggaaagcgggtgtccggctcaaacagatcgtttggctccgtccggtgacggcgctttctgaaggcgtgacgcttcatgtaaagcttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcgcatgtcaaaggctgagtgctatgaagcattcgacagtctcggcatcacctacggaccgtctcatcaggcgcttgacgccgtctatgccggaagcggagaagtgctcgcgaagctcactcttccgccgtacgcccgcgaagaaaaggagccgttcatcctgcatccgagcatgctggacgccgccctccaggcttctatcggtctcgtgcactcagacggttccgcgtccggacggccgtttctgccgtttgccctccaagatatgcaggtgttttctgcgtgccgggagacgatgtgggcggtgctttcctcagcggacggcgcctatcatattgagctgtgtgatgaaaacggcgaggtatgtgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacaggggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatcaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtattgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagaaggcggtatgcgcgtggacaaagagacagaacggctgatgtatgaacagaccggaatgaaagccatgcgatcggcttcaggcatccaggcgctgtacgccgcttttgcctccggagcacaccaggtcatggtggcagaaggcgacgagaaacggattcgaaaaaacctgatgcctgaagcgccggaaccgtcacgcagcattcatgtgtcaaggaagacccacgtccatctgccaaataaagtacaagcggaactcaaacatatgatatcaggcattctgaaggtgaaagaagaagaaatagatgctgaatcagagatgagagattatggatttgattcggtttcattcacgcagtttgcaaatgaactaaataaaatgtatgggcttgaactgacgccggccgtgttttttgaatacccgacagtctttagttttgcccaatacttgctgacggaacatccggatacattcggcccacaggaagaaacagaaacggagaaaccggttgagcgtaaaaaaatgaagacggagccattctcgattccgtcccgccttcctaaaacaaaaaccgcagctgaacctgaagagcccgtggcgataatcggaatcagctgtgcatttccaatggctgaaaatccggaaatgttttgggagaatttagccggagaaaaggactgtatttctgaaataccgccggagcgctgggactggagacagtattacggagatccgcagaaagataaaaatgcgagcaatgtaaagtggggcggcttcattgatgaaaccgctcaatttgatcctttatttttcggtatttctccgcatgaagccgaaatgatggatcctcagcaaagacttttaatgatgcatgtatggaaagcgattgaagatgccggctgctctgcaaaaagcctgtcaggtacaaatacaggcatttttgcaggcacgacaaacagcggttacgctcaggaagcttcaaagttccatatagagattgagggttcttccgctgccggaacggttccgtcaatcggtccgaaccgcatgagctattttctgaatatacatgggccgagcgaaccgattgaaaccgcctgttcaagctcattggtcgctgttcaccgtgcggtcagggcaattcaggccggagactgcggcatcgcgattgcaggaggcgtcaatgctattgtgtcgccggacatgcatatcagctttaataaagcaggaatgctcagtgaagacgggcgctgcaaaacattttccgatcaagcggacggctatgtcagagctgaaggtgccggcatgattgttttgaaaacattatctgatgcggaacgtgacggcgaccgtatttatgccgttatccgcggaacggcggaaaatcatggcggaagggcggcttcccttacatcgccgaatccgaaagcgcagacagaagtcatgataaaagcgtatcagcaagcgaacatcgacccccgtacagtgagttatattgaagcccacggcacgggaacggcgctcggagatccgatagaaatcaacggactcaaagcggcttttgcagcgctttatcaaaaagccggagtaacggcacccgatcagcctcattgcggcctcggttccgtcaaaacgaatatcggccacacagagcttgccgccggcatggccggacttttaaaaattattttgcagatgcagcacaaaacgctcgttaaaagtctgcattgtgaaaccgttaatccgtatatcagcctcgacggcagcccgttttatttcgtccgcgaaactcagccgtggaaagcggcgactgatgatagcggaaatgaactgccgcggagagcgggtgtcagctcgttcggatttggcggtgtcaatgctcatgtcgtgctcgaagaatatgtttctcctgttgaagagaaacaatggacggccggtgaacttcagccgtccttattcattctctcggcaaagacggcggaacagctgaaggaacgtgcggaacagctgcgcagatatttggaaaagtcacattcagctgacggagctcttgcggatatcgcttatacgcttcagcttggccgggatgaaatggaagagcgccttgccgtcattgctgaaacaaaagaagagcttacgaacgcgctgaatgatttcctcagcggcaaggagacggggcagaatttctttacaggccggaacaaagcgatgaaacagctgtttacagagatgacggacaatgcagaaatgagcggggccgtagatcaatggtttgaagcaggaaagtatgcaatgcttgcaaaattatgggtgcaaggcttgcatgttgattggagtaaattgtatcaggacgaaagaccgaaaaaagtcagcctgcctgtctatccttttgcgaaaacacattgctggataccgcacagtgcgcagcatataaggcaccgggagacttacgggactgatacgtccccgcttgagacttatgagcgcctgcttgatgaattggagaaaaacgaaataagcatagaagccgctgtaaaaagaacgatcggtttttacagggattagcgtaatggaggaaaccatatgaaagagtttctgcaccgggttttttctgacgtcaaaaataaaaaaatgacaaaacaggatgcgatcggcattttgcgcgattatgatatgcggatgggacttcgccaaacggattcccttcatccgcttgctcagcagcatatttccgatgaaacgggacagggattctcggcagctttcagcggccgggaattttttctcgctgatgtttctttacagcataaaaagcttatgcctggagaacttcttttggaaatggcgagagctgcggctgttttgacagtaaaggagactgcggctgtccggctgacgcatatcgtgtggtcaaagcccattctgactgaggctgagccgttccatatcgaaatcaggctgatacccgcagagggtgaagccaaaaggtttgagatttataatccattttctgctgattccagtcattatgatgtgtacagccaagggacgattcagccagttgatgctgcgcccggcatgctggatatcagccgcttgaaggaaaacagcggttccctgatggataagcagcaaattgaagccatcactcagaacgataccgttcaatacagtgagcacatgaaaggaattgagcgtatttacgcttcatcaggacggatgctggcagacatatcaattccattgacaaaccaaaaagaatccgcccgattcggcctccctccctgtgtgatgcaaagtgtgacagaggcatgcgcgctgcttggcggcaaagaatataaaacgctcgctccggtttcattggacgagcttttgttttatgaatcttgtcctgacaaggtatgggccgagatacaagagaaggcggggagcttttatattgatttatgtgacggagaaggaaaaatatgggcttctctgtcggggttgaagctgcagcctgtcatcaagacgggcgcttccggaaaaaccaatgccgaacaccgcagtgaacgtttgtatgaacaaacgcttcttcagctcaaaacgctttttggcctgactgcaaaaattgctgtttccaacatagatactgaagagccgctggaaacttacggaatcgactccgtcactgtgacgaaattgaaccgcgaattgtctctgcttttcggtgacctttccaaaacggttttttacgaatataagacactgggctccctggcagctcactttgtcacggattatccgaatgaatgccgaaaatggacaaatgatgatgagcaccgttcaggcatatcagaacaggttttggcaaatgaagattttccggtgcttccgtcgtttatcaagcgaagaaaacggcctgctttttccaatgagaaacagacaaaagaagggattgcgattatcggagtcagcggacgttatccgcaagctgaaacacttgaagagtactgggataacttagcggccggaaaagactgtgtgaccgaaattcccgaagagcgctgggaaaaggacaggtactacaaccctgatcccgaagcggccgtgaaagcagggaaaagttacagtaagcggggcgggtttctgaaagatgccgctttctttgatccgctgttttttcaaatttcaccccgtgatgctttgaatatggacccgcaggagcgtctctttattgaaatgtgctggcaggtgctggaggatgccggttatacgaaggaacagcttgagaatctgtataacggccgggtcggcgtttttgccggcattacgaaaaacgggtacggaatgtactggaaaaacggcggcaccctgcagccgaaaacgtcgttcagttcagcggccaacagagtttcctattttcttaatctgaaagggccgagcatgccggtcgacacgatgtgctcgtcttcgctgactgcaattcatgaagcgtgtgaaaacatccttcgcggcgcatgtgacatggcgattgccggcggtgtgaatgtgtatacgcatccttcggcttatgcggagctcagcgcctatcgaatgctttcaaaagacggaacgtgcaaaagtttcggtgaaggcggggacggatttgttcccggggaaggcgtcgggaccgtgctgttaaagccgctgtcaaaagcgatggctgataaggaccatatttacggggtgattcgcggcactcatatcaatcacggcggcagaacaaacgggtatacagtgccgagtccgagcgcccaggctgacgtgatttccggcgcgcttgaaaaatcaggaatacatccgcggatgatcagctgtatcgaagcccacggcacgggcactgaactcggagatccgatcgaaattgacggtttgacccgcgcatttcaaacgaaaacgtcagataaaggcttttgcgccatcagctcagttaaatccaatatcgggcatttggaagccgcggcaggcattgccggtgtaacaaaactgctgctccagtttcaaaaacgaaagctggccccttcattacattgccgaagcttgaatccgaatattgcatttgaccggacgccgtttgcggtgcagcgtgaattggcagactggaaacggccggtcattgaggaaaacggagcgcagaaagagattccgagaatcgcgggaatctcttcttttggcgcgggcggggcaaatgcccacatattgatagaagaatatattgaacctgatagggagatttctgagccattcacagatgaagatcccgcagtcattttattatccgccaaacaggaggccagcctgaagcagcgggcgcagcagcttcttcaagcgatcagaaaaaatgacgtcacagaccgcagcctccgggatgcggcttacacccttcaaaccggaagagaagcgatggaagaacgtgcggcgtttatcgtgacgtcgacagagcagttagcggaaaaactgcagtgttttattgacggcggaacagacggctgcttcaggggaaaaagcaaacagtataaagatattctagccgtttttaaggatgaagatatgcaggaagccgtccgtaaatggatgaaaagaaaaaaattcgcgaagcttctggaactttgggtaaaagggctgaagattgattggtcagagctttataacggcagcctgccgcatcgcgtcagccttcccggttatccatttataaaggatcgttattggccggacgatgcagcgccggacaatgttcgcggtgctgaaacacattctgaaacatttcgtgaattccgctttttacagaaaagctgggcagaaagcagccgtgttccggctaaggaagtgcggggcgtcatcggaatagccgctgatcaccagacaggaaatttggccgttgagctgtcccgttatttccccgagtctgaaatcattgacgctgcatcaccggaaatatccggggacgcggcccggtttggcggtctgattgatgtgacgggatgcgggacggaaatcaagcatgatgacggctggattcatcgtctgcagtctctcatcgacaacagaaaccgcggccgaaagctacagctgctttgtgtgacaaaggggcttgaaccttttgcgaatgaaacgataaatctctcaggtgcaaaaaaggccggattgtaccggatgctccaaagtgagtataaggatatccgctcgcggcatatggatgcagaacggactgccgaagattccgagctggcaaaccagatcgcagaggagttttttcgcgattctgcagacatcgaagtgtgttaccgaaacggtgtgcgctatcacgcgcggttaaaggaaacaaacagcttagctgaaaaagaattttcatttccgaaagaccatgcgctctggatcaccggagggacccggggactcggatatttattcgcccggcattttgccgaacgttacggagtcacgaaactcgtgcttaccggaaaagaaacaatgcctccgaaagcggagtgggatgatcatatcaaacggaattccccgttttccgataaagtgagaagaatcagagagctcgaacaaaaaggtgtccgaacggaagtgctgtctgtatcttccggccctgaatatgagcaggccgtcagccgggtgaaagagaagatgggaccgattggaggcgtgatacacgcagcgggagccgtagatctcgatcatcccgcctttatccgcaaaacaagagaacagatgatgactgtgcttgaacctaaaactgacggactggaccttttgtatcaagcgctgcacaaggagcctctccggttttttgcgctgttttcttcagtgtccggcgtgatgccggaattaggagcgggacaaagcgattatgccatggctaacgcctatatggattattttgcggccgcaaaaggttttccggtgctgagcatccaatggccgagctggaaagaaacgggtatgggcgaatcaaaaagccgggcctatcagaaaagcggtttaaagagcatcactgacagagatgggctgagcctgtttgatgccgttatggcaggcgattgcggatctgttattatgccggccgtcattcacccggaaaaatgggagcccgaccgtctgatgctttcaaccggccttaccgaaacaaagcagcatgtacagggtgagacagaaagcgtagaggagtggctgacgggcatttgctgccgggaattaagactggagccgtcaagatttgaatctgatacaccgtttcaagattacggagccgattctatcatgcttgcccaagtgtccagagcgatcggaaagaggatcaaagctgaccttgacccggcggtgctgtatgaataccctacggttgctgcgctggcgggatggcttgaaacggcatatccggaaatcaaagctgccgtttcaaaaccggttcagcctgtaatcccggacgttcccaaacaaacagcagccgctgtcattcagccttctggcgctgcagcggcgcaagacatcgctgttgtcggaatgtcctgccgttttcctggagctgaatcaattgaagcttattggaagctgctgtctgaagggtcgtcggctattcaaagggtgccgaaagaacgctggaaaacggagaaggcggattatgcgggccttttaaaaaatgtaacgcattttgacccggagtttttccttattcccgaagaagacatcaaggcaatggatatccagtcctttcttatattagaagaggcgcttcatctgttcagagacagcggttactctttacaagaaatgaaaggcaggtcagccggtgtctatttaggaggacgcggcggcagtatgcctgacgaaaaccgtctgaagcatgcaaaaaatccgatagtcgccgccggcccgaattacttggcggccaatctttctcagttctttgatttgaaggggccgagtctcgttttggatacggcctgttcttcagcgcttgtcggtatgaatatggcgatacaggcgctttcttgcggtgaaatcgactcagcggtggtcgggggagtcagtctgctggaatccggtcaaacccaccggatgttcgaacttcgcaatctgttaagcgaagagcctgcgtttcatatttttgaccgccgcaccggaggcatcgtattgggagaaggcgtcggaatggtgtatttaaaaacagcggcccaggctgtaaaagacggggaccggattcatgcggtcattaaaggcatttccgtaaacaatgacggcagaaccgcggggcctgccacaccgaatatacaggcgcagaaagaagtgatggccaaggcgcttgccaaaagcggcagaaaagcggaggatatcagctacattgaagcaaacggttcaggctctgaagtaaccgaccttttggaactgagggcgattgaagcggtgtaccgtatgcaaaacagcgcgccttgcgaattggggtcgatgaagccgaatatcggacacccgttatgcgctgaagggattgccggattcattaaaacagtgcttatgctctcgcgccgaatgcgtgtgcctttcctttcgggcaaagagccgatgacgcattacgatctgtccgcctcgccgttttatttttcgcacgttctgcgtgaatggacggattcaccgcggattgccgccgtcagcagtttcgctgacggagggacgaatgcccatgtcatagtggaagcctgggagcaggaggcgtataccccggttagaaagcctttgccgagacaggaattaaaacgccggcccatccgtccggacaaagctgaaaacctgcatgaaaacgcacatgaatcccgcccgaatacgttttggaaacaaatgaagacttactgattgcgctgaaaattgaacgtcgatatggaggaagttcatatgcaagagcagcttcttattaacaatcagcatcccgttctgaaacatcataaagcctatggaaaggaactgctgccgggtctggcttatattgacctgatctatcagactttcagagaaaacggtttttttcatgccggccttgaactcaggcacttatcgatttttcaccctttagctcctgaacagggagaaacaatcctgctttccgttgactgtacagagaacggcgaagggcagtggaaggtagaggtgaaagggcaaaaacaaggtgacgaagcagcagagacaaagatatatgccgcggcgcaaatgcattccgtcaagcccgccggcttccaagagagcgtccggatggatgccgtaaaacaaacggcggcagaaataccgcttgaggatatttacgcggaatgcagggatcaagaactggttcattcaggaatgatgaaaggctgcggaagcgtctaccagactgaaaaagagatttatattgatctgtcggtgcaaaaggatcagctggaacatgcagaagaggcgatgtttcatcccgcattgatagatgcgagcagcatcggctccaatgtatatctcgctcctttgacgagggaggaggggcaattatttctgccgctgttttatgaatcattttattgcgccgaattgctgcagacgacatgtatcaccaagataaaaaaagaatccgtcacacgtaagaaagatctcgtttacgtgacaatggagtttttcaatgaggaaggcagaaaagtcggcgaactgaaaaacttcgccaataaacgggtgagggacccggaactgatcaatcagaaacggcaaaagaaagaacctgacgggcggaatgccgtcccggctccgcaagcggaaccggcgccttccgagccccgccgtgcggaggcttccgccggccttactgaacagtgcatcctttatttaaaagaattgcttgccgcccgattgaacaaacctgtgaaagagattgacccggatatcggctactatgaaatggggctggattctccggggctgttggacatggtaaaggaaattgaacgaaaaatcggaacgcagcttctgccgacgctgttatttgaatacacgacaatcgcggaattggcgggatatttgcgcgaacattacggagccggcttcggccatgctcaaagcgggcatccaaatgctgaacctttgcgccgggaaaaaaagaggacgacccaaaaccgcgtgaaaaaatcggcgtcagccggaacgcagaatggagatattgcgatcgtcgggatggcgggacggtaccccggcgccaaaaatcttcgtgaattctgggcaaatttaaaaaatggagaaaacagcgtaacggaagtgcctcgttcccgctgggatacgaggaaatatgagcatttgcgatcgccgtccggcaagccgatttccaaatggggcggttttatagacgatccggattgttttgatgcgaaatttttccggatttctccgcgggaggcagaagctaaagatccgcaagaacgattgtttttagaaacatgctgggaaacgattgaggatgcaggctataccccggaaacaatcgttcagccgaaagggccgaataagagaatgaacgtcggtgtgtttgccggggtgatgcatatggattattctctcgccggcgctgaagctgcggccaaagggctggtctttccttatcccttgaactatgcgccgatcgcaaaccgggtttcatatttctgcaattttcacgggccgagcatggcggttgacacggtgtgttcgtcatctctgacggccgtccatatggcggcggaaagtctgagacgcggtgaatgtgaagcagctcttgccggaggcgtcaatttatcattgcacccgacaaaatatatcacatacggcttgatggatatgcattcgagtgacgggctgtgccgcacgttcggcgaaggcggcacaggctatgtctcagctgacggcatcggggccgtgctgctgaagccgcttcacaaagccgaagaagataaggatcatatttatgcggtgataaaaggcagcgccgtcaatcacgtgggaaccgtcagcgggattaccgtgccgagcccagtggcgcagggggatatgatagctgaatgtcttgaaaagacggggatcgatcccaggacgatttcttatgtggaagcgcatggaaccggaacttctttaggagatccgattgaaatacaaggtcttgttaaagcttaccgcacgtttacggaggatcggcaattttgtgcgatcggttccgttaaatcgaatatcggacatgcggagtcagccgccggaatcagcgggcttcataaaacggttttgcagctgtttcacaaaacgcttgtcccttctttgcactcagagacgattaatccgtatctccgtttagaggactcgccattttacgtgcagcaaaaaaccgagtcatggaaaaagccggcgtatacagagaacggcagagaacattcctgtccgagacgcgcaggcatcagttcattcggggcgacgggttcaaacgttcatctcattttagaagagtacaggcccaaaaaccccggcattacggagaatcaagagagaccgtatatcgtgcctctatcagcgaaaaatccggagcggctgaaggaatacgctgcccgcctgctgatgtttctcaaagataaagcgcttgaaggaagcgggtcgctttatgacaaaacagatacaatgcaaaatcagctggaaaatgcgctgcgcggtgctctggcggaagttctgcatgtagaggccggctcggtagatggtgaacaggattggaaggaattcggcttggatgtcatgcagctgacacagttttctgagcggctgacggatcaatacgggctggcaatagacatgactgatctcatacagcatacttccgtccggactttagcagaatgtctgacaaacgatgagaaacataagaatattctttccggtcttttcggtcagtccggcttagagaagcagtctgatgaacctttttccctgcggtcactggcgtatacgctgcaaacgggacggctggcaatggaagaacggcttgtttttttagtgaacgatcaagcggacctgatcaggaaattaaccgaatttacagaacgaaaacggcagattgacggctgctttcaaggccggtctgatagcggaacggaaatcaggggtttcctgaatgatgatcaggatacggaggagctgatccgaaaatggacggacagcggcacttacaaaaaacttgcggagctgtggtcaaaaggatttgagatagactggacgcggctgtatcgggaggagaaaccgcgcaggatgagtctgccgacatatccgtttgcgaaggagcgctattggataccggagcccgatcatcccgtcacttccgtaaatacagaaagcaggcttcacccgctgcttcaccgcaatacatcagatttgttagaacaaaaattcagcacggtactgaacggagatgaattcttcttagccgatcatatcgtccgaaacaagcgtgttctccccggggcggcttatcttgaaatggcgagagccgcggctgaactggctgccgcgccgttagccgctgaatacacggctaaaaccggcatttcgctgcggtatatcagctggatacgccaggccgttcataaaaaagagccgctgcgtatgacgacaggtctttccttagaggataacggcaatatttcatttcaagtgtacagcaatgaaaacgattcagacatttattgtgaaggcagtgctgtgattgagccgctgtctgaggcggcggttttgcatattgaacagctgaaagcgcgctgccgcaaaaaagtgctgtcaaaagaagactgctatgcggcatttgcaaaggcggaaattgtatacggaccttcacatcaaggaattgatcacatttattgcggggaaaaagaagccttggctaaattggtgctccctgcttccgtttgtgatgaggccgaacagtttgtgctccatccgagtctgattgattccgcttttcaggcggccatcggcgttatgaatgaagataaagcgggttatccggagcagccgttaatgccttttgaattgcatgaactgaccgtttttcatccgtgcagtccaaacatgtgggcggccgtatttgtgacgcatgaaacacgggccgtgcgaagaatggacattgatatatgtgatgaacgcggcaatgtgtgtgtaagaataaaaggattttctgcccggatggccgaaagtgcgccggccgtaaccgataataagcaatacgatctgccgggtaaccttaccggagccgtcaaactgatgcaggtatgggacgcggaaccgatagacaaccaaaccggcttccccatttctgaagcaaaagctgtcatcataggcggtacagacgggcaggcggacgcggttttacgattgtttcctaaagctgtgcgatttgatagcagccaaagtgcttccgttgaagtgatatccgatcggctccgccgtgtcggtgagattcagcatatgatctggtttgcccctcagccggctgattcttacatccatgatcaaaaaagcggggtgctgcaaattttcagagcggccaaagctcttatcggtctcgggtatggaaaagagcagctcgggatgacggtgattacgcaccaagcacagcctatcacccaatatgatgaggtgcgtcccgctcattccagtgtgcacggtttcgtcgggtctctcgcaaaagaacatccgagctggcacatccgtctggtcgatcttgaagacggggggatttccctgcagaagacatattcagcctgccccgcgaccgtacgggtaaagcatgggtgcgcagacatcaggaatggcaccggcctcaattgcttccggtccaaagcgggccgtctgaaagtgttccttaccgatatggaggcgtatatgtcatcatcggcggtgcgggaggcatcggcgaggtttggacagattatatggtgacggcgtataaagcccgagtcgtctggatcgggaggcggccgctggacagccggatacgccaaaaaatagaccggtaccggccatcaggcccggctcccgaatatatagcagcagatgcttctgatcttccatcgcttcagcgcgcctatgaacagattaaaaacacatacggcaccatcagcggcgtcgttcattcagcgatggtatttgcgaatgaaagcgtaaaagatatggaagaatcacagtttcacgccggccttgcggcgaaagtggatatttccgtcaacattgccgaagtatttgcgaaagagtctttggactttattctctttttctcttcggttatttcatatattaagaatccgaatcaaagtcattatgcggcggggtgcgcatttaaagacgcatttgcccatgagctttccgggcggctgtcatgcccggtcaaagtgatgaactgggggtattgggagcgggctgacaatcacatttctgaagagtttgacagactgagtgcaatcggtctcggactgatcagccgggcggaagggatgcaggcgctggaaactctgctgacgcagccgatctcccgcatggggctgatgaagctgaccaagccgattccgatcgagggaatgaaccctcatgaatttgtgactatctgattgcctgtcaaaatgacggagcaaatttaattttcttaggaggataaggttttgggtaagggagacaaacaaaaagaccgtacacagttatccttaagaacagaaataagcaatcaaatgaaagaattgaatcagcttttgctgcaagtgctgcgggtgacgctgcgttcaatgggtctgaccggcgaagcgccggcggcttcctgtctgcctttatatgagcgctggctggaagaaagcatccgtcttttagacagcgatcttaaaagcggtgaaacggccgcgatttgggaagagtggcataagaagaaaaacgaatggctgaaagatccggatatgaaagcgcaggctctgctggcggataccgtcattcaagctttgcctgacattttaacaggcaaaataaaagccactgacgtgatgtttcccgattcttcaatggagctcgttgaaggaatctataagcataacattctcgctgattattacaacgatgtgatggcaaatgaagcgtgtatttatgtggaaaatgtaattaaaaacaatcctgaggcaaacatccgtctgctggagatcggagcgggcaccggcggaacgagcagcacactgtttaaaaagctccgcccctatcaaaaccatattcaggaatactgttataccgacttgtcaaaagcttttttaatgcatgccgaaaaggaatacggcgcggacaatccgtatttgacgtatcagctgtttaatgtggagaagcctgcggcgggccagggattacatctgagaacctacgatatcgctatcgccgcaaacgtgctgcatgccaccaaaaatatccggaaaaccttacggacggcaaaagccgtattgaaaaaagacggtttgctgctcgttaatgaactgggcggacatacgccgtttacacatgttacattcggcttattagagggctggtggctgtacgaagacgaggcgctgcggattccggggtgccccggtctttatccggaaacatggaaatcggttttaatggctgaaggctttcattccattcaatttccggctgaaaacgaacgtctgcacacccagcagattatcacggcgaaaagcaacggagtcatcaggcagagcagggaagcttacaccgcgcaaaagcgccaatcaaacgtaccgcgaacattctctgatcgtcagctccccatcaaacaagcgggagaagggctttcggaaaagacagctgcttttctgataagggctgcggcaaaagtattaaaaatgccggcagaagagataaatccgctggctcctctggatgaatacggtattgactctattctgatcgttcagctgacgaacgagctgcgggatctcgtccctgatatcagcagcacgctgttttttgaacaccgaacgatagaagagcttgccgcatacttggctgaaacgaaggagcgcgaactgcttgcgcgattttctgaagaagtccgtcatactgaagcggtatcatcaggctctttgcttgaaaaaagcacagagtatctgaaacagatcgtcagcgtcatcttaaagatgccgattgaggacgttcaagcccatacgccccttgaagaatacggaattgattccatcttaatcgtacagctgaccaaccgcgtgcgggaagacgtccctgatatcagcagcacattgttcttcgagtatccgacaatcggcggattagcggaatatctcgtcagctcaagacaggaagatatggctgggattttcaagacaaataaagaagccgaaaaggtgccgcacactctacagaaaaagcaaagccgcaaaaaaagcgccggattgacgaagcgccaagcggcatctttttctgaaaaagcgccgcccgcctccgaaccgccgtcaaaacaccttgaagtggcaattgtcggtcttgccgggaagtatcccggagctgaaaatgttaatgagttctgggaacggttaaaaaccggtgaacacggaatcaccgaaattccgaaagaccgctgggattggcgggactactatgatgagacaaaaggtaaggaaggccggatgtatacaaagtggggcggctttttaacagacattgataaatttgatccgctgttttttaaaatctccccgaaagaagcggagcgcatggacccgcaggagagactgtttctggaaaccgcttatgcggcccttgaggatgccggatatacccctgattcactatgcgccggtaaaaaggttggtgtttttgcgggtgtcatgaacggcaactatccgacaggggcccactaccactttatcccgaaccgcgtatcctatgtgtttgattttcacggtccgagcatcgcggtcgataccgcatgctcctcatccttaaccgccattcatctcgccgcagaaagcatcagaacaggtgcatctgaatgcgcgattgccggcggcgtaaacctgattacagatccggttcattatatcggactgtcttctatgagaatgctgtcgccgtcaaacgcgtgcaaagcgttcggtgataaggctgacgggtttgttgacggagagggcgtcggctgtatcgtgttaaagccgttgaagaaggctgttgaagatcatgatcatatatacggtgtcattaaaggaagcgctctgaacgccggcggcaaaacgaacgggttcaccgttccgaatccgaatgcacaaggggaagtgatcgcagacgcgatggagcgggcaggaattgacccgagagcgatcagctatctggaagcccacggcaccggcacttccttgggagatccgattgaagtcgcggggttaaccaaggctttccgccgctatacggatgcaaagcaattttgttccatcggttctgttaaatccaatatcggacacctggaaagtgcggcgggcattgctgccgtcaccaaaattcttcttcagatgaaacacggatatctggtgccgtcgctgcattcaaagcagctgaacccggaaattgattttgaaacttctccttttatcgtgcagcaggaaacggcggaatggagacggccggtcatagaatctgaaggagtaacacgggaatatccgagaatcgcgggtacatcttctttcggagcgggcggggcaaatgcccatctgctgatagaagagtatgaaccggctgaaatgacttcggcggactccggccgtccggcgctttttgttttatcggcaaaagataaagaccgcttgcgcgagcgggctctgttgctgtcggatgccgccggaaacggaacaattacagatgcaaatctgcttgacgcggcatttacccttcaagtcggcagggttcagatggaagaacggctggcgatgacagcggactctgtttctgaattggaacagaagctgactgcttttctgaataatgccgattccgtaagcggggtgtttacgggccggagtgatagtgctgtcacagagacggaaggcacagtcggtgattggatggaaaaacgtcaatttggcagtcttttgaatgcctgggtccacggggcgcccgtcgattgggcatctttatataaaggcgcgctgccgcatcgtatcagtctgccgtcttatccatttgcaaaagaaagctactggatgaagcgggaagaaccaaaaacaggaacaactgaatatgtgcatcctttcctgcatgaaaatacgtcaaccttggcggagcaaagctatcatacatcttttacaggccgggaacacgttttccaggatgtgagaggagagcgggttctgtcggcagccgtttatttagaaatggcgcttgcggcttatcatcatgcggcagacagctctgaagaaaaagagatatggatccgaacggcggcatggactgacccgattaccggcggacatcacggtgcgggcgtcaatctctcccttctgtctgaagacgaggaaggcatccattatgaaatatacagtgatgaagagaagctgcatcattatggaatcatcggtcaagggaacgtacagccatcccgcatgcttgatattgcctccttacaaaaagactgtcgcccgctgtcattcgattatgaaacaccaggcacatcaggtgtaacgatcagtaaggagttccgcaccgttgaaaagctttatacgggagaaaatgcgatttgggcgaagcttgctcttacagatgaaagcggccgtaatccgggatatcatctaccgccggaatttctggacgcagcttttcatgtcttggcaaaaacggagccgtcagtccatatcgtgcctgaaacggttgaagaactgcgcgtcatgcgtccgtgttcatccggcatgtggatgtatatgaataaaaagaatcaaaccggctgtgacattcaattttgtgacgaaaccggcattgtatgcgcagaaatcaaaggggtgagaatgagacagccgtctcagcaggatcacgggcaagaggaacactccgagatgatgatatttgaagaaaggtggacgcagcagcctctgaagaaatccattcatgaagagctgaaaacggtcatctgttttcttacgggagaagctgccagaaaacatgcttatcggtctttacaatccctttatccgggagccggcgtgttttttatttcacagggtgaggaaactcaaaagctttcaaacacgcattatcaaattaaaatcactgacggacaagcatatcaagaaacgtttcggcatattgaaacggctgcaggcaaggcggatgccgttttgtatggatggccgcttgaagatgaaaaggccgtgaaagactattccattctgtatcatgtgatccgcgcagctgcttctttgcgttctaaaccgaggcggatccttctttccgctcagtgcgggaccgaaaccgatatcagttacgccgagtcatggatcgggctggaacggtcgctgaaactgatcctgccggagacggatacggccgcggtttattttggacaaagaggaccgtttgaaaagctgatccataatgtatgtgaagagcttcacagcgggtcgttccgcagtgtcatgtacagtggggaaatccgtcacgtcatggaaatgaagcagacggatattgcccctgttgagaggcgtgtgataaaaagcggaaaaacgtacttgattaccggcggatgcggaggtttgggcttgttatttgccggatattttgctgaaaaaggaccggttacgctcattttgacggggagatcagcggcaggcggcccggtgctgcacaagataaagagattggaagaatcaggcgccaaggtgttttacgtgcaggcggatgccgcagatcaggctcagatggagaaaggtttgcaagaagcgaaagagaaaggatgcgggccgattcacggtgtcattcacgctgcaggtcttcaaggcactgaaagcattctggagaaagatctgcaaacctttcagcaagtcttatcgccaaaaacggacggcacagcggtgttagatcaggttctgtcacgggagccgcttgacttcttctgttgtttctcttcttcttcagcgattttaggagacttcggttcttgtgactacgcaatggggaaccgcttccaaatggcttttatccgccaccgggataaacttgtgagcctcggactcagaagcggcaagtcacttgcaatcaattggccgctttggaaagaaggggggatgcatgtcggcacggcggaaagcaccgatatgtatttaaaatcaagcggacagcgttatttatatacaaaggaaggactcgaagcttttgaaacattgttagtccagccgtccagccagtatctcgtcctggccggttttccgtcgagggccaaacgcttcctgcagatagatcaaggcgaacggccgatttcgggttctgtaaataggaacgtcccgttttcaggaaggcggagtgaaatgaaaggctttacactggaagaatgcgtaagctgggatgtgaaggaactggcggcggggcttttgaaaatagacaagaacagactgacggatgctgacaatctggctgatttcggctttgattctatcagtttggcggaattcgcctcttctttgtccgctcactacggaattgaagtgaccccggccctgtttttcggacattccacactggagaaggtcgtccgctattttctgacggaacacaagtccgtcatagagcatgtctatgaagaaaagaaacctgaatccgcagatcaatctgtctttgaaaaggcaggaacggaaaagcgaaagaagcagaggggaagaaataagctgaacgccggaaccgagggcagtcaggcagctgattccattgccattatcggcatgagcggccgctttcctcaggcgcgcacggcggacgagctgtgggacattctgtttcaggaaaaggacgttgtcgcaccggtcgcaaaaaaaggcttcacaagttcaaaatggaaactcggcgctgtaccgggggcggacgaattcgaccctttattttttgaaatatcgccgagggaagctgaaacgatggatccgaagcagcggctgctacttcaggaagcgtggcgggcccttgaggatgccggctacggcgccagtcacatcaggcagcagacgatcggtatgtttgtgggtgcggaagaaggagattatcaccttttaacacgggacaaaggcaatgtcacgtctcatcataacggtattttggcggcgcggctggcttatcacttgaatttatcaggtcctgtgatggcgataaatacagcatgttcttcggggctcgtttctgtccatcaggcggtattaagcctgcagaataaagagtgtacaacagctgttgcggccggggtgaatatcatgaataccccggacttttttgaaacgatagataaagccggaatgctgtcggaaaacgggaaatgcttcgcgtttgataaaagggctgacggcctggttcccggggaagcggctgcggcggttgttcttaagccgctgagagaggcggaagaagatggcgatccgatttacggggtgattcgggcgagcggcatcaattatgacgggaaaacaaacggaattaccgctcctagcggcgtcgcgcagacccggctgcttacttccgtttatgaccggggccgtatcaaccctgaagatatcgaatatatcgtcacacacggcacgggtacaaaactcggtgatccggtggaaattaacgcgctttatgacgcattttctgcctatacaaacgaagaagcattttgcgcgctcacatcaattaaaaccaatatcggccacacgtttgccgcgtcaggcattgtcagtttgatcagtcttttacaggcattctcccgtgaaatgattcccgccagtctgcattgcagcggggaaaaccgctatatcaactgggagaaaagtcctttttatgtgaataaaacggctaaagcgtggccttctctgccgggtaaaaaccgaatgggggcagtcagcgcattcgggatgagcggaacaaacgcccatgtcgttatggaaagctataagcgcagcgcttcacctcatccggatgcccctgcttatttactgactttatcagcaaaaacaaaggaggcccttcaggaaaaaatcgaagatatgatcacttgggcggaaaatggcggactgaaagaaaatgatctagcccagctcagctatacgttgctaaaaggacggcatcactttaaccatcgcgccgccatcgtggttcaagatgctgatgacgcagtgtatgtatggaagcaggcaaagcttaatgaacatcatccttatgtgttttcgggaaaagtaccgcagcactttgcaggccgacagcatattcaggagcacataatagaagtgctcggcaagtgcagcgcttcatattctgaccatagaaaatatcaggaactgttatgcgtgctggcagatttttattgtcaaggttatgaaattgaaggggacttgctttatggcggacctttgccgcgaatcggcaatctgccgggctacccgtttgccaggcagacgtattgggcgtccgatcgtcttcagggagagcttgaaagccggaattcagctgaacgtgaaaagcttcacccgctgctccatgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcggaaaagcgggtgtccggctcaaacagatcgtttggctccgtccggtgacggcgctttctgaaggcgtgacgcttcatgtaaaacttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcacatgtcaaaggctgagtgttatgaagcattcgacagcctcggcatcacctacggaccgtctcatcaggcgcttgacgccgtctatgccggaagcggagaagtgctcgcgaagctcactcttccgccgtccgcccgcgaagaaaaggagccgttcttcctgcacccgagcatgctggacgccgcccttcaggcttctatcggtctcgtgctctcagacggttccgcgtccggacggccgtttctgccgtttgccctccgggatatgcaggtgttttctgcgtgccgggagacgatgtgggcggtgctttcctcagcggacggcgcctatcatattgagctgtgtgatgaaaacggcgaggtatgcgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacagggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatgaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtactgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagagggcggtatgcgcgtggacaaagagaccgaacggctgatgtatgaacagaccggaatgaaagccatgcgatcggcttcaggcatccaggcgctttacgccgcttttgcctccggagaacaccagatcatggtggcagaaggagatgaaaaacggattcgcagccatgttttcgatctgcgtgaagaacaaagcgccgccgcaaaagctccggcagagacagatgcaggagatctgaaagatcgggttcaagagaaactaaagcgtcatgtatcagatcttttaaaggtaagcatgaaagatattgaggctgacagcgaactgacggaatacggatttgattcgatcatcttcactgaatttacaaatctattaaatcggtcttatcagcttgagctcagcccgactatcttctttgaatttccgacattgcgcaaactgagcggccatttgatatctgaatggaaagaagcattcagcggcttagaaagagagaattttaaaaccgccccaaaagccggaataagaaaagctgaagctccggcggccgttcatgtcaaacgggaaacgcccgtatccgtaaaaggaaaatcagaagaaaaaaccgaaccgatagccattatcggaatcagcggtatttttccgcaagcgaaagacatagatgaattctggacacgtttatcaaaaggagagcattgcatcacagaaattccccgggatcgctggaattggcgcgaatattacggcgatccggcagcggatgcaaataaaacgtcaattaaatggggcggttttatagatggaatcgccgggtttgacccgctgtttttcgggatatctccgaaagaagctgaaatgatggatcctcagcagcgcctattaatgatgtatgtgtggaaagccattgaagacgcggggtactcggcaaaacggattgccggaacaaaaaccggcattttcaccggcacattgggaagcggatatcaaaccttaatcaataaggcgggtcttcctgtcgaggggtatacgatgaccggaatcgtgccgtccgtcgggccgaaccgaatgagttattttcttgatatccacgggccgagcgagccgatagaaaccgcttgttcaagctctttagtcgccattcaccgcgcggtaaaagccattgaaacgggagattgtgatatggcggtcgcaggaggcgtcaacacgatcgtcacgccagaagggcatatcggttttcaaaaagcaggcatgctcagtgaagacgggcgctgcaaaacattttctgatcaggctgacggttatgtcagaggagagggtgccggcatgattgtcttgaaaaagctttcagaggctgagcatgacagggatcacatctacggcctcatccgcggtacagcggaaaatcacggcggacgctcagcgtcacttaccgcgccgaacccgcaggctcagacggatgtgctgaaaagcgcttatcaaaaagccggtattcagccgtcaacgatcacttatatagaagcgcacggaacaggtacggcgctcggagatccgattgaaatcaatgcattgaaaaaagctttccaaacagacggggctccgggcggatattgcgggattggctcagtgaagacaaatatcggacatttggagctcgcagcaggcattgcgggcgttatcaaagtattgatgcagctgaaacatcggacgctcgccaaaagtctgcattgcgagaacatcaatccccatatcaaattgaaggacagcccgttttacattgtgacagaaacaaaggagtgggaagcgctgcgtgatgaaaacggccgggtcctgccccgccgggcgggtgtaagctcattcggtttcggaggcgtcaatgcgcatatcgttattgaagaatacatgggcaaaagtgagacggaacagccggaaacccgtgagaaagcgtcatctctttttgttttgtcggctaaaaatgaagagcggctgaaagaaagagcgcgtctccttcgcgattttatccaaaacggatcatcccgccatatcgatcttgcagatgttgcatacacactgcagaccggacgggacgcaatggaagcgaggctgggaatcattgcaggctccgcagaggaactgactgaaaaactgaacgcgtttctgacgggaaaaaacagcgaagatatcatcagcggccgtaaaaaacgcgagaataacacgatctccatgttctcagacgatgaagacgcagctgacctcgtcagcgcctggattgagaaaaagaaatacaagaaagtgctgcggctctgggtaaacggatttgacacagattgggagcagctgtatacggacagtaagcctcgccgcatcagcctgccctcctatccgttcagagcagaccgctattgggtgccgaaacgggagcagctgccgctttcgaatcaaaaaacagtagtattgcagaaaacatgggagccttgcgaggcagtgtcttcatccgagccattcagcaaaatagcgctcatcgtctccgaggatacaaaagaccttgccgccgaggtgaaaaaacagctgaatgatgctgacattgtgcaggaaaatcagctcatctctttcttacaggatgcgaatgcggccatctattccgggtttattgacttcaccggctgcggctcccgacaaaagcggcaggacatcagctgggtggcatcgctgcagcagctgattgaatacggccgcggaaaagaaaacatgaaaatgctttatcttacaaaaggccttgaatccttcaaaaataatgcggccgctatgcatggtattgaaaaagcggggctttatcgcatgctgcggcatgaatacagccatattctcacctgtcacgccgatattgatcctgaagagccgctggagcagacagccgcttttattaaacaagaaattgaatcagacttaacggaatctgctgtttgctacagggacggcatgcgcttcagctatgttcttcggcagactgatcagattgaaccagaagccgtgcaaacagaccggactgtgtttccaaaagacgccgtcctcatgataaccggaggaacgcgcggactcggcgctttatgcgccaagcatttcgtttccgcatacggtgtgaagaaactgcttctgacaggcagaaaggagctgccgccgaaaacagagtgggatcttgagcaaacagaccctgtcgtttcggaaaaaatacagcttatccgaaagctggaatcacagggcgtaaaagtgtgcgtctcagcagttgatctgacggataagcaggccgtcggacggcttataaaagaggtaaccacaacgctcggacctgtcggaggcattctgcattgcgcaggaattgcggaccgtgaaaaccctgcttttctccgcaaatccaaagacagtatcgcgcgggtgctcgcaccgaaagcagacggcctccgcggtctgtatgagagtgtaaaggatgatgcgccggcatttttcgtcctgttttcatctgtctcggcagccgtcccgattcttgcggcgggacagagcgattatgcgatggctaattcttatatggactattttgcagaaaacaatgagggcggcatcatgagcatacaatggccggcatgggatgagacgggcatgagcagggatacaaaaagcgggatgtatcagcaaacgggattgctgcgtcactctgacgcggaaggtctcaagatgcttgattacattttaagagaaagacccggaactgtcgtgctgccggcacaagtgaaaaatgattgggacatcaaagcgcttgaaaacgccaagccagccgcccataaaggaatgagaacagcttccaaacctcctgaaacaaaaaaacgggtccataaccggactgatattcaatcttggctgaagtcgcttttggcaaaagagctgagtatcgatgaaacgcatatggatatcgatgtgccttttcaggaatacggaatggattctatctttctggcgcaagtgctgacaaagatcgatcaaaaactgccgtccgtttcaattgatccgactgtccttctggaacaccctaccatagaacagctcgcggattatttagccgcacattgtccggaagctttttcggcagatgcagcggttcccgcggagaaggtccctttgcagaaaacgccgaaacagagcaaaaaaacggcagataagcccgggaaacggggaaaggttgcgatcatcggcatggcctgtcattttccggaagcgggggatataaaagaattttggaagaatctccgcagcggaacggatgccgtcactgaagttccgccggacagatggaacgccggggaacactatcagccgggtgaatatcaagaaggaaaaagcatcagtaaatggggcggttttattcatgatattgatcaatttgacccggagtattttaatatttcagaaacgctggcaccgatgatagacccgctgcaaaggcagtggctcgaagtgagcgcggaagctttggccgatgccggttatcaaaaagaggatctctggggccgccgtatcggcgtttttgccggtgcaagggcaggtgcgtttcatcagaaatttcaatatttgcaaaaagacgcgattattggcgcggggcaaaattttattaccgcacatatggcgcacatttataactttacagggcccaacctggtcgtagatacggcctgctccagttcgcttacggcaattcatttggccgtgcaggctattcaaaatggagaagcggaggcggcctttgcgggcggggttgacattttgcttgatgaaaaaccttttctcacaatgagcgcggcgagaatcttatcgccaaatggccgttcaaaatctttcgatgccgatgcggacggaacaggaatcggagagggctgcggtgtgctgatgctgaagccgctcgaaaaagcgatagaagacgaagataaaatatacggcgttattgacggctctgcgataaataatgacggcagcacaatgggggtgactacgccgaatccccgggcgcagcaggacttgattgagcaggcggttcaatcagcggaaatcgagccggacaccatgacatacgtagagacgcacggaaccggtactttgatcggcgacccgattgaattaaaaggattaaccaatgtcttgtctgcttattccgatgaaaaacaattttgcggtgtagggagcgtcaaaagcaatatcggccacttgctgagtgcggcgggcgcggcgggaatcatcaaagttttgctggcgattgccaatgaagaactgccgccgactttgcattgccataaaccgaacccccgctttcaatttcatgattcgccgctttatcctgtgcttgagctgaagcggtgggacggaaaaaaagagatactcagggccggggtcagcgcgttcggtttgggcgggaataacgcccatatcattgtcagcaacgaaggaattccgaaagaacgaaaagcgaccatggaaccgaaaggcggccagacagtataccgaaaacagcggtattggcctgaaaaagcacagttgtccgaagcggaagaaaatgaggcgggcacagaagcaatgtttgaaataagcgaggtgtgatagattggcagttgccaccgatcaagtcaaaacgttcctgcagaaaatcagccatacgaattatatcgtccgggatcatcgcgttcaccaaatccgcgtcctcccgggcgtgactttaatagatatgctgtatcggctcgccgccgggtatctcggtgaaaggcctatagaattaagacagattatttttaagcagcctgttgtaacatctgaagagtttgataaacacctgtatgtcacctttacgccggcgcgtgacagctggaaagttgagattacaagcgaaaaagcaaaaaacggcacaccgcttggcggaaaacgggatgagaatatggaatgtcagctttatttgcaaaaagacacgccccgggcaaaagagctgaatattgaagcattcatgaaaaacgcaagccgaaaatgggacatgcatgacatttacggaattgcaagaagaagccatattgagcatggcgagtttatgaaaaatgaaggggccgtttatcagcttcaggataaagaagaattaatggagctcactctgagtgatttggctgaaggattccgggagaaattcaaggcgcatccggcttttttagatgcgtccacccttgccggctcttcctttgcattgtcggcccaaaagcagaatgacacaccgtatattccttttatgattaatcgtttttgcatatatcagccgtttccgaaaacgatttacacttattctgcggaaaacagccgcactgaaagcggcgcatcagatagcgaacctgatttttattcggccgacttcacgatttacgacagggaagggaacgtattggccgaatgtgagaaactgacagtaaaaagggtcagacaagcgaatatgattacccatctgatagacaaagagaagccgcctcagcagaacaaaaacggccgtggagagcccgaaagtcctgtggccgcagaagacgtgtctgaacagcaaacgccggaacaaaacatggtgacttacataaagtcggaaatcgccaggctgatcaatcgtccggcacaggatattgatgtgcggaaaggcttttatgatatggggcttgactcggcgcatttgctgaagcttgtaaagatattagagcagacttttcagcagcagttttatccgacactgctttttgaatattcatctgtccgccgccttgcggattaccttatcaatgaagcgggctgtgtgctgaaagattcggccgaagaacggcatacatcagacgctgacatcgctgatgaggttctgttttttgaacccgcctggaaagatcatccgctggaaacggcggtgcagaacgggcaaaaacacacccgtcatcttattattgctgccgatgcaggaccccgtctcaccggtgaactcggcacacattgcccggaagcggaagtgatagaactgaaaagggagcatgaggttgcagatgagcagtttggagcagatgccgagcttatatttcgtatgcttaaacgggaactgacagaccatccgaaagaacatacattgattcagcttgtatgcgccgttgagaatggagcggcattgtcttccgctctcggggctatgctgaaaacggcacatctggaaaatccggctcttcgcactcaggtgatcaccttctgtgacaagaatgagagattgccaagtgagacggccgcaatcattagaacagaagcagactgctctcatgcaggctgcacagacattcggtataaagacgatatgcggcagatcagattgttcgaacgtattgagaaaccgggcggacagacacagtctccttggaaacaaaacggcgtatatgtcattacaggaggtctcggcggtcttggatttctgcttgcccgtcaccttgcagaaaaagaaaaggtgaagctcgcactcatcgggcgttcgccggaacagtctgagaagatcagcagactgaaagcattgggagcggaagttctttacgttcaagcggacatcggcagcaaagccgaaacagagcgggcatttgctcagattacagaaactttcggccgtctgacgggcatttttcattgcgccggtgttttaaaagatcaatttatcatccaaaaagacagtactgacttgaagagggtgttcctgccgaaaatcagcggcctgattcatgcggacgaagcttcacggcatgaaccgcttgaatttttcgccgcattttcctcattctcggcgttgaccggaaatgcgggccagacagattatgccgcagcgaacgcttttatggatgaatatatgaaatatcgcgattgcaaagcggaaaaaggcgaacggaccggggcttctatgacgatcaactggccgctttgggaagatggcggcatgcaggttgacagtttgatgaaagagatcatgaatgatgcaaccggcaccagcccgcttccggccggggaagggatggcttcactagaatatatgctgcgtctcggcaagctgcaatccgttattttatacgggaaggagcctgctgtaactgaaagcatggcccgattggttccgatggcagacaagaaccgctcttcattatcccatgcagctgtcaagagaaggagccgaaaacaagagagacatacagaagagcacgatattgccgtaatcggattggcgggaagatatccgcaggcgggaagcatcgatgaattttaccaaaatctgcgctcaggtaaagactgtatcacaacaatgccgaaagacagatggaaaggttatcctttctcatatgaagcagatcagttctactgttacggaggatttttagatcgcatagacagctttgatccgctgtttttcaatctgactccgcgccaggctgaaatgatggacccgcaggcgcggctgtttttagagacggcttgggaagcttgtgaagatgccggtttttatcaggacagaacggcgcgcgggccatcttcacaaaaaagaaaacgcgtcggggtattcgcaggtgtgttttggagccattatgagctgttcggcgctgaaatcacacagcggggcacaccgctgtctatgggcgtgacgcctgcctccgttccgaatatcgtgtctcactgcctgaactttacagggccgtcaatggctgttgatacgatgtgctcttcttcgctcacatccatacatttggcatgtgaaagcattaaaaggggggagtgcgaattcgccattgccggcggtgttaatgcggtcacacatccgcataaatatgcgtttttggcgaatgccggatttctgtcttcagaaggcgtctgcaaaagcttcgccgacggcggtgacggctatgtgccgggagaaggcgtcggcgcggtgttgctgacaaccgttcaagaagcggaaaagatgggctgtccgatatatggcgtcataaaaggctccgctttaaaccatgtcggaaaaacatccggtttgaccgtgcctgatccggcatcacaggcggaagtcattacagattcctttcagagtgccggcattgatccggagacattgagctatattgaagctcacggaacgggtacgtctctgggtgatccgattgaaattgaagggctgagccgcgctttccgcaaatggacaaacaaaaagcggttttgcgccatcggctctgccaaatcaaatatcggccatttagaaggagccgccggaatcgccggattaacaaaggtgcttttgcagctgaagcatggagaaatctttccgtcattgcacgcggacacgctgaatccccatattccatttccggatacgccgttttatgtggcggaccggctggaagaatgggaacggccgtcacatcctgaccagccgagaagagcgggtttaagttcttttggcgccagcgggagcaatgcccattttgtcatagaagaatatctgccgccgcaggctgaaaagaaatcgctgagtatacgggaagacgagccggttctgtttctgctttcggcaaaaaatgaagaacggctattggaatatgtcaaacggtatgaccgctttttacgggaaaaagaagtcaatcttaaagacctggcctacacgcttcaagcgggcagagaagcgatgcctgaacggctggcattgatcgttacatccgtttgcggcctgcaagcgaaactgaaggatgtgcttgaacggaaaacggaaattgaagggtgtttccgcggacgtgctcaagatgttatttcaacaagtggaatggccgagcttttgaaaaacaagcaatattccagattgctcacggagtgggcaaaaggagccgccgttgactggagccagttatacgaaggagagaagccgaaacgggtcagccttcctgtatatccgttcgcgaaggagcggtattgggtgcctgtgcctgcggatatccggaaacagacagacgaaccggcggaaaaccaaaagatcattcttcaaaaagactggaagcagcaagatccggcggagtctgaagcattatcaggaacagtaatgatacttgcaactgataagacgagccgattggccgatgctctatttaaaggaaacggccatattgaaacgatctgtttcatccatcaggcaaaagacggcgccgattattacgctgccgcatcggggcgaaacctttacggcagagtgcgggagtctcttcaaaacaaacagatactcggggtcgtcgacataaccgcatatgatgcggaatatgaacggcgggaagagatagaatacggaaagcttgcctttttacagcaggttctggaatcattccgtcatagcggcgctgtgctcagccaagtgacacaccgcctccagcctttcaaggaaagtaaacctctgatgcagggggcgaaaacggcggggctgtaccggatgctgggcgctgagtatgccaacattcattcttttacgatagatagcgattgtgcgattgagcatacagaagaattaagcagacagattgaaactgaatttttacagccgcgggccaaaagcggcagtgaatgctgctacaggctgaatcgccgttatgtgccgtttctgaagccgggtacgaatgtgtctgcggtgcctgagctttcctattcgtctgatgatgtgctgttaataacgggcggatcgcgcgggatcggcgcaattgcggcggagcatgccgtttcacgcgggtgcagaaaactggtcatcatggggcgggagccgcttcccgattcctcggagtgggaagacatgaaaaaggacggcattctcccggaaaaagccgagcggatgcagaggttagccgagcggggcgcggagatccgttattacagcgtttctcttacggatcaaaaggggctccggaacatgacggacagcatccgcggcacaatgggaccgattaccggtgtttttcattgcgcgggtgcaatgggagaacaccccgctttttataacaaaaccgaaactgagatcgaaagcgtttgcacgccgaaagtaacagggcttggcggtctctatgaagccgttcggaatgagccgctgtcgttttttattttgttctcatccgtttcgggtctgatcccttcgcttgctgcggggcaaagtgactacgcgatggctaattcatttatggactcttttgcaaatcatcaggcaggcaaaggaaacgtgtttgttaaagccgttcaatggcccgtctggaaagaaaccggcatggctgaaggcctgccggaaacacctgcttatcaaaaatcaggactttccaggctgtctgccgaagacggactgaagtttttagattacatcatattaaacggacaaagctgcggaattccttgtgttcccgaagacagtaaggctgattttggtgatcttctgaaggtgaagaaaactgaagctcccatgaaaaaaagcagtgccggtgaccaaaaggtgaaggatatgattcgtcaatgggtgcgcaccgttttcagcgaagaactgaaaatgacggatgagcagataaaagatgatatgccgtttgatgaatacgggattgactcaatactctttgcggaattggttcaatcattgcaaaaacggatcagcatcaagttaacaccgtccttaatgcttcaatatcaaacgattacagaaatggttgactatttcgcagcgcatcatgaagccgattttgtgacaaaagaaaatggtttcgttcaagacggggacgttcagcctgatgtaaccgccgccgctgaagagagaacatccatgaagccgaaagcggataccgaagacgatattgccgtcgtcggcatctcctgccgttttccgggggcgggcggaacggatgctttttgggagctgctgatgaaagggaatactgccatccggcctgtccccgcatcgcgctggcatgcaacagcaaatgcaaaggattatgcggggtggattgatgatatcgacatgtttgatgcgggctttttcggcatctctgaaaaagacgcggcaattatggacccgcaggcgcggatcatattagaagaagcggttcattccgtttatgatgccgggtacggccaaaaggatttgtcgggccggaaagtcggcgtgtacatcggcggcagggcgcagccttcagccggtatggaacatatcctgcaggcgcctaacccgattttgggggcggggcaaaactatttggcggccaacatttcacgatttttgaatgtcacagggccgagccttgtcgtggatacagcatgttcctcagggctgatcgggctgtcctttgcaaaagacgcccttttggccggaaggattgacgcggccttagtcggttcggtgagtctgctcttatctccgtccgcgcaccggttattcggagcgcgccatattttaaatgagaacggcgtgtttcatatattcgaccgtgaatcagcgggagaagtgctcggagaaggagcgggggcggtttttatcaagcgattgagcgatgcggtgcgggacggagaccgcatttacggcgtcataaaagccgtctcggtaaacaatgacggccggacgctcggtcccggttcaccgaatataagagcgcagagagatgtcattcaaactgcgcttaatatggcggaaaagtcgcctgaagacatcggatatatagaagtgaacggaggcggttccccaatcgttgattcggtggaaatcaaggcgctctcagatgtctatcagctgaaccggaaaacgcttctgccctgccggatcggatcggtgaaaccgaatgtagggcatttgcttctgtcttcaggtcttgcgggcttcatccgatgtgtgctgagcgtctatcataagcggattccgcctttcttatcagcgcgtgacccatttgaacattatgactttgaagcgtcgcgtattcattttaatcgtgaacccgttgattggcattcagagaagaaaccccgcgtcgcagctcagagttcatttcctgacggcgggacaaatgctcatatcctcgttgaagaatacagaggtgaaagacagcgggaacatcaccggtcgcctcagccgccggaattcagaaaaaaacactacccgctcttgggcggctggaacagcacggaaagtgaaccggaaaaaacaagtaatgaaaaaacggacattgcggatcttttaaagaaatatgagaaaaaagcagagacaagcactgcacctgcagactcgttttggcaggtgacaacgtgacgtttttaaaaggggactaaccatgaaaaaaacagtgaatctgcgcctgacggcagagcatcccattatgaaaaaccatcttgttcacggagaatctgtcatgcccggtctggcctatattgatatgctgtatcagctggcaaagcaaagccttgatctttcattccgttccatctgtctgaaacgggtgaccatttatcatcctttatcagtgaagcggtcagagcggcttgatgtgagtgtcatattcagtaaagaaaaggagttctggactgcctcgatttgcgaggcggattccgggacggttttcttatcagcggagatgcatgaagaagtcttctcatcagacaggcgtcttgacgcaggggagaaaaaacaacaagccgcacttccatcagtctccttgcatgcggtttacgaagccgcgagaagccgcggactgtcgcatgacgggctgatgaagccggagggagagatctatgcttatgaagaggcatgtttccttgatattcggcagtctgattcatgccgggaaaatctccccggcgctctctttcatcccgcgctgatggacggtgccgccatggcctccggcgtattgcagacagctgcaggcgccgagttatttttaccgatttattatgagtcgtttattgccgctgagactgttacggagcgctgttacgcggtgatttcgaaaaagtccggcacgccttctgaaatggtgaaaatggatattgacttttacaacctcagcggtgcgcatattgcttcactgctcggcctgacagccaaaaaggtgcggtttgaccggcagctgataccaggcgttcagcagatggaggaaaccttataccgcattttctcgacatacgtaggccgttcagtcacaagaaatgatgcgcacaccgtgttttttgaattaggtcttgaatcgtcacagcttctggctattattaaagacatcgaaggggcgtttgatctgcgtctgaatccgactcttttatttgagtgcagcagcatatccgaactgctcgaagacataaaaacaaaaggaacagatgaatcttccagccttgtcgcagatgcagcaccggtctctgaaacacaatcaggcagtcagacatttactttctatgaacatgaagcattccttcaggatcatctggttttcggcaaaccggcactgatgggtgtagtgtatccgtgtctggtgcttgaagcatccggagcgtctcattccggcacgtgtcccgccgagctgaaagatatccgctttacgggcgggcccgtcacgctggagcctggagaggccgcgcagattgacatttcatttgcggcagaaaagagtgccgaacgctttacagcaagctgcactgtctccggtaaagaaagccggaagacatgtgcggaaggagaaataagcagatatacagaggcacccataaaaaaatcatatgacgttgagcaaatgaagtcgcatgcacaaaaggtggcgccggatgtcatttcccgtctgtacgattcggttgccgacttcacgataggcccgatgctgaaaacggtaacagcgggatacaaaatgagtgagagctcctttttattgcagctggacttatcaggaaaaaaagaaaaaggcgatctgcatcactttgcatttgacccgcttatattgaattcatgttatatgtcgctcggtgaagaagaattgcagctgaaaaagcggattcacgtcccgctcatgattgagaggctgacgctttacggacctgtcatgtctgataccgtctatgtggtgaatacaatcaaacataaaaaagacgggtttctctcatttgatgccgcaatcctcagtcataccggggaacagctggcggaattgaaaaatgcgtctgtgaaagaagtgcttcagccaaatcggcttgaaaatgcgtcttttgccccgtccgggaatcaaagccgtcaggaaacgaaaggaaaaccgctggatattgccattgtcgggatttccggcaagtatccgcaggccgatgatatcgatgcgttttgggataatctcaaacaaggcaaggattgtattaccgaaattccgaaagatcgctggaaatgggaacattacttttccgaggaccgtacggcgccgggagcgatctacagcaaatggggcgggttcattgacgggatcgccgattttgatcctgagttttttaagatttcccccgggaagcggaacaccttgatccccaggagcggctgtttttaatgcatgcttggatggccatggaggatgcgggatatacgaggacatcacctgaactggggcgtcaggtaggcgtgtatgccggtgtcatgtatcaggaatacccgctattcgcggctgaagcgggagtgaaaggacggcatatcgggctccccggcgggatttcatccattgctaaccgtgtctcctatttttgtgactttcaagggccgagcatttcggtcgatacgatgtgttcgggttcgctgacttcattgtacatggcgtgccgggatctgcgggatcatcggattcgcgcggcgcttgccggcggagtgaatctcaccgttcatcctaacaagtacttcatgctgagccaggggcagttcatctcatctaaaggacactgcgggagtttcggcgccggaggtgacggctatattccggcagaaggggtcggggtgctgcttcttaaacgtttagaagacgccgtacaagacggagatcggatttacggcgtcattaaaggagctgccattaatcacggcgggagagcgagcggttacaccgtcccgaaccccaaggcgcaaagcgaagtcatttctcaagctttacaggaagcgggggtatctccgggccggatcagctatgtggaagcgcacgggacagggacgaaattaggcgatccgattgaaatccgggctttaaccgatgcattcggtgatgttcctgaaacatgtcttgtcgggtctgtcaaatcaaatatcggacatggggaatcggcagcaggcatcgccgcagttacaaaagtgctgctgcagatgaagcacaaacaaatcgccccatccttgcatgctgatgttttaaatccgaatattcaatttgatgaagggccgttttccgtctgccgtgaattaacagattggaaacggatttcagcagacggagaagaacagccgctcagggcgggaatcagcagctttggtgcgggcggttctaacgcgcatatcattattgaagaatatgaggctcctgtcaaacaagcaatcagcagccaagagccggcggtcattctgctgtctgcgaaaaatggcgagcgtctgacagaatatgcggagcgccttcttgcttttcttcaaaagaagcatattgataagccggacttatttgatgtcgcgtacactttacaagcggggcgcgaagcgatggatgagcggctggctctcattgcggactcccttaaggagctggaggacaagctcagatcgtacttggaaaatgaaaacgcaccgcatctttacaggggacgggcgaagcgaaatcatgagacagtggctgtgtttgaatctgatgaagatttgcaggaagcgatggttaaatggctgaaaaagagaaagtacggtcatttgctgaaaatgtgggtgcagggagtcgatgtggactggaacttgttatattcggaacaaaaaccccggagaatcagtcttcccgtctatccgtttgcaaaagtcagatgctggattcaagatgaagccgaggcggtttcaaaaagggatgacggcaaaacggtgatccatccgctgctccatgaaaacacatccgatctttgggagctgaaattcacctctgtttttaccggacgggaattctttttcactgatcacacagttaatggacagaaggtgctcccgggagccgccgtgatcgaaatggccagagcggccgttgagcgtgccgcatacgctgtgccggacggacgtaaaggaatgtatttgaaagatctcatatggatgaggcctgtcattcataaagggacggatgtagaagtccatatcagccttattcttaaggaaaatgaagacattgaatttacgatttacagcctatcggaagaacctggggagaacggattttatacagtaaaggcactgcggtatcgggagagatagcagcggttccgtctgttcatttagagggctggctgtccggctgcagtcaatcggttatgacgtctgatgaggtttatcaggctttccggcatgcgggtatgatctacgggccgagccatcaaggcattgatcagctgatgatcggagagaggggggctgcagcccggctgtcgctgccggaaacggcagacagtaccgccgatcagtttgtcatccatccgagtcttctggatgccgcgtttcaggcgtcactgggggccggttcagatactgccggagacactccgatgctgccgttttccctgcggcaggcagaaatatttcagccgactcagaaaacgatgtgggcgcttgtccgcaaacagagcgatcggtcagataacggagcgctgacgctggatattgatttatgtgatgaaaacggcgctgtttgtatgagattgacgggcttctcctgccgggctgtccggcagacaaaccaaaccgaaagcaaacggcaggaagttcagacggcgatgcttgcccctgtttgggacaaaactttcttttccctggaagaaaatcgagcggttgatcaggaacaattgctgatcatcggaaagccgggaaataccataaaggccgcggcaaaaatgtggccccgcgcccatctggcggagacgccggatcattcaagcgagcaaacattacgtgaattgacagccggttatcaagatatccgccatttcttatggattgcgccggatcgtttcgcacccgcatccgccagtcaggaaatgcttgatgagcaggagaatggggtgattcaatgtttccgtttcatcaaagcgctgctgtcactcgggtatggaaaccgaaacatcagctttacggcggtcacccggcagacacagtccgtgtatccgggtgatctcccgcagcctgagcatgcaggcgtacacggtttgatcggttcattggcaaaagaatatccgaactgggacatcaggctgattgatgcagaagaaggcagtgattcgtctgagatgaaaaacatctggcgccttcctccagatccggacggaaatgctgccgcgtaccgtaacggagcttggcacaagcaaaaaacagtccgggtgctgacaagttccgctccgcgtatgtcgtacagagaaggcggcgtttatgctgtcatcggcggagcgggcggcatcggagaagcatggagcaaatacatgatcacccgttacaaagcacggatgatatggatcggcaggcggccgaaggatcaggagattcagagcaaaatagacaggctggccctatcaggccccgcgccgcattatatacaggctgatgctcaagatgccgcagcgcttaaagcggccgtccgttccataagagagcgatacggcaatataacgggagtcatccattccgcgataacgcttgccgacaaaagtatggcgaatatggatgaagcttctttcagaaacgctttttcagctaaggtgaatacgagcgtccgaatgatcgaagcttttaagggagaaccgcttgattttgtgctgtttttctcatccgttaattctttcacaaaaaatgccgggcaaagcaactatgcggcagggtgtacatttcaagacgcctttgcccgccatatcgcttccttgcttgattgtgaagtgaaagtcatgaattggggatattggggcagtctgggcgttgtatcagacccgtcttacagaaaacggatggaggcgtcagggatcggttctattgaacccgatgaagcaatggaggcgctggaagtcttactatcagaaccgttcagccaagcggcattcatcaaagctgctccgcacggcttagccgcactgacggatcaagatgcaatatcggttgtatccggcccggagccttcatttatggaaagcgtcaagcggcaaaatccggatcggaatgaacggcttgagactttaaaacgagaaatggagttgcgcatatgaacagccttctttgcaaactgctcttttatcaattacagtcaatcgggtttttcagcgagcctgtcaccacacctgcagcatccatgcggagcgccggcgtgatcggcacatacggcagatggctggaagaaagcctgaatctattaaaagaaaacggatatatcgcgtatgacggatacacgatcactcttctcgcggatcagcgcccggacggccgcacagtctggaatgagtggaatgcccataaacgcctgcttcccaagggggagcttgcgcaagctgaattggccgaggcgacgataaaagcgatgccttcaattttaaaaggagaacgtccggctacggatatcgtatttcccgattcatcaatgcggctcgttgaaggtgtttataagcataatcccgttgcggattattttaatgaagtgttagcagattccgcggccgcttacctgaaagcctaccttacagaacatcccgatgcccgtatcaggctgatagaagtaggggccgggacgggcggaacgagcgccatgctgtttacaaaactgaaaccatttgcaaaacagattgcggaatattgttatacggatgtttctaaagcttttttaatgcatgccgaacaggaatacggacctgatgtgccgtatttgacaacagccttgtttaatgcggaggagccttgcgaatcacaaaatatcaaaacgggtgtttacgatattgtcatcgccgccaatgtgcttcacgccacaaaaaatatcggtttgacactgcgccgtctgaaagcgctcctgaaatacaacgggatgattttgataaacgaaatcagcgatcgttctgtttttacccatttaaccttcgggctgcttgacggctggtggtcctatgaggatgctgagcttcggattccgggaagtcccggcctatatccaaaatcgtgggagcgtgtgctgcattcggaaggatacagagcggtttgtttccctgctgaaacggctcatgatttaggtcagcagattatcgcagctgagagtgacggactcgtccggatgcaagggatcagagacggcagaaagccatacgccgccccggccgaagttttccgaaagcccgcacagcctgtttcccgcagccgcgcgccagaggagcatcaagctgttaaggctgatggggaatcggtcgcttcccatgtccgctctgtcatcaaaacaagtattgccgatgtattaaaaatgaaagaagaggatattcaggaagaactgaatttctctgaatacggtattgattccattttggccgtcaatgtgattaacgagattaataagcgattgaatcttacactgcagacaacgattttatttgattactatcatgtgaaactgctgaccggttatatctcggcagaatatgaaaccatcatagcctcatctctggagaccgaaagagcgaaaatccgcccggtgcttcaggaagaacggcctgctgaaaaacctttgaagacggatagaaaggaaaacggttatcagaaaccgaaacaagaacggatgccgctttctttcgcaaagtccgatgactcgggaatgttccgggttgtgattgaccgtccgggcggcattgaagatctgacgattgcccgcagtgaagtgcccgagacaaaagatgacgaagttcaaatagccgtccgcgccttttctttgaacttcggagacttgctttgtgtcagagggctgtatccgacgatgccgccttatccgttcactccgggattcgaagcaagcggcgtcgtgatcaagacagggaggcatgtaacatccgtcattccgggtgatgaagtgattgtcggtatgggagaggaatttggctctcaggcgaatctcatcacatgtaaagaacatcaagtctatcataaaccggcccggctgacctttgaagaagcatgcgctcttcctaccgtggcagtgacaatgatagacgccttccggaaagccggacttaaaaaaggcgaaaaaatattaattcagaccgcgacgggaggaacggggctgatcgcggtgcaaatggcccggcatatcggcgcggaaatatatgcaacggccggatcacagaaaaaaattgagtatctgcattcgctcgggatcaacaataccatttgctatttggaagaagattttgaaacggaaatcatgcgaatgaccggcggccgtggggtggatgttgtcattaataccctggccggtgatgccatgcaaaaaggaatgaattgcctggcgccgggcggaagatatatcgaaattgccatgactgcgctgaaatccgctaaatcagtcgacttgtccgtccttcataacaatcaatcgtttcacagcgtggatttgcggaagctgtctcttcaaaatccggatcaggtcaaggactatcaattggaactgcagcggctggcggaagagggagtcattcagcctgtcatctcaaaaatcttttcctttgaagacataaaagaagcgtatcactgtctggatgaccgcggaaatatcgggaaaatcgtcatcagcgtttctgagccgtatcaaatgacgtaccgccccgaacaaaaggatccggccgaaacggtaaaatcagcagctgtgttacctgaaaaagaaccgatcgcgattatcgggatgagcgggcggtttgctgaatcggagaatgtccatgagttttgggaaaacttagccgccggacgggatctgattaaaaaagcagacagatgggctgtctctgacagtcaatgccagtatggcagttttatagagggcattgaatgttttgatcccgttttctttcatatatcgggacgtgaagcaacctatatggacccgcagcagaggctgtttctggaagaatcatggaaagcgcttgaagatgcgggatatgcgggagactcggtaagaggccgggaatgcggcgtgtatgccggctcctgcggcggagattaccaggccatttttaaacagcaggggcccgcgcaggctttttggggcaatcacaattccgtcactccggcaaggatcgcctatcaccttaatttacaagggccggcgatcactgttgatacagcatgttccagttcgctgacagccattcatttggcatgtcaggggctctggacgaaagaaaccgaaatggcggtggcgggcggggttttcattcaatccactcccgctttttatcagtcgtcaaataaggcgaatatgctgtcaccgaccgggcgctgccatacgtttgatcaaagcgcggacggcttcgtgccgggtgaaggcgtgggagcggtggtgctgaaacgtcttagcgacgccgtcagtgacggagatcatgtgtacggcgtcataaaaggctctgcaatgaatcaggacggcgctacaaacggaataaccgctccaagcgcgctttctcaagaacgattggaacggcatgtctatgatacttttcacattaatccggaaaccattcaaatggtggaagctcacggaacgggcactgcactgggcgacccgatcgaattcagcgccttaacgcgcgctttccgccgctatacggataaaaaaggatattgcgccatcggctctgtgaaaaccaatctcggacatgccgctgcggccgcggggatggccggattgtttaaaatcctgctgtcgctgaagcatcggcagattccggcttccctgcattttcatcaagccaatcagcatattcaatttgcggacagcccgttttttgtgaatgaaaagctgataccgtgggaacggaatccggatgcaccgcgcagagccgcgatcagttcattcggattcagcggaacaaatgcccatcttgttattgaagaggcgccgcaaaccgtgcgccggtcaccggcaaaaccggcctgcctcattcctttatctgcgcggacggagcgtcagctggaaattcaggcagaacgcctgctggattcactcagcaagaacaaagacagcgatctgggaaatataagttatacgctcctgctcggcagaaagcatctgcatcaccggtttgcctgtatcgtaagcagtgcggacgaactgaagcgggtattatcggagtggcttgtaaaaagagagcttccgggtgtgtttgtgtccaatttgaaggaccagaagccggcagacgaagccggaatgaaaacattcggaatggaatgcattgaacagtgctgctcggcggcttcacccgcacagtacagagaaagcctggcacatatcgctgaccttttttgcagaggatatgatcttcctttcacacggctttttgacggagggcaatattataaaacgccgcttcctgcctatccgtttttaaaagaaaggtattgggcggctgatgtaaacagttctttaccaggccaagccatgaaaaagtctgaaacgcaaaccgttcccccgtctccgccacagcctgaacatgaaggtctgatttctctgagtcctttaactgagatcgaaatgacagcgtttgaaccggagacattgcaaaaaccgatcgtcttacagcctttggattgtactgttcctgtccagcagccggaaaacgccgtttccgaagacaatagaacattgcttgaagaattgaggataagcctggcagatattttatttttgtcgccggaagatattgatgctgatgagcctttcatcgacatggggcttgactccattatcggggttgaatggatacaaacagtaaataaaacgtaccacactgagattactgccaataaggtgtatgaacacccgacgcttgaggagcttgcggaatatatagcggggcaaataaagaaacccgagtatgctgaagcggaggaaacagcggtacgtccgcaaatcccggaagcagaaactccccttgccggcatctctgacggcactttgcgcaaagagcttaaagaaagccttgcggacatcctgtttctgaagccggaagatattgatgagcatgaggcattcattgacatggggctggattctattatcggtgtggaatgggttcagtctattaataaaacgtatcaagcgtctattacggcaaatctggtctatgaatatccgacaatcgcaaaattagccgggtatctgaccggttccgttcaaaaagacactgatgaagtacatgaggaacatacgaaacaaaacgatatatcagaagagacagatgatcaagaaccgcccgaactgatctgtcttaacccggggggaaagggaagaccgattttctggtttcattccgcgctgggggcagtggagctgtaccagcctgttgccgaacggaccgggcgtcctttttacggaattcaggcaagaggatggatgacagaccgggaaccgatccgcggcattaaaaacatggcggaatattacgttaagctcatacgtaccgtgcagccccggggtccttacgatgtaggcggctattcattagggggcatgctcgcttatgaagtcacccggcaattgcagctggctggagaaaccgttgagtcaatcgtcatgctcgactcctttgactcggcgggtgcgcgggaaataaacattcctgatgaattatttgataaaaatatgatgctgcagacggtgaacatggctttatttgcaccgatctatcaacatccggaacgcatttctgaaaccttgattcaccgtgatgaactagatgccgatcttcatgaagacatatttttagagcaattaatagcaaaagccaaacagcgggggttaacgaagacggacgcgttggtgaaaaatctgatcaggcagaatataaacgttcaggacgcttacgaaatcactgattacgaactcctgccgcttccggatccgaacggggtgacatgctattatttccgaaataaaaacggtattttcttgggtgagcttgatccgtattttacgatcagggccgatattttatccgctgatttcgtcaactactggagccagtggcaagagcatatgacaaacatcgccatcatggatgtggcggtatccaaccatatgacgttattggctgaagacagcgcagccgaaacgatttctgaattttgcggcgttttatattcggcagacggaatgacagaacacagctttctgaaactgcaggaaaagatactgaacgtgcatggtgagatgctgaagcagcccgccaaaataagaccgtaaattcacatatccgcccgccgggtttactcgtaagctttggcgggtcatttcaaatcttggacacatcttggaggaatgaaaatgaccagtttaacaaaaatcagacagcagcagccgtacaagtggtaccaaacgatgagagaaacctctcccgttcattacaatgaaaaggaagattgctgggaaatcttcacctatgatgaagtgaagcgggtgatttctgactacagtcatttttcttccgatcataaatacttaagtgcggacaagcaggaaaaaatgatccggcatattaacaaagacagccttttgaaaatggacccgcctgaacacaccgtcttcagaaaattggtcaatcagccgttcatgccgaaatcggttgagtctcttgcaccgcgtatagccgctatcgctgatgacctgcttcaggccgtccgttcaaaaggcaggatggacattattgaagattacgcatttccgcttccgattatcgtgatcgcagagcttttaggatttcctccgaaagacagggatatctttaaaagctgggtcgaccaaagccagaatgtaaaagatgaaaagaaaatgaatgaagtgcaaaagcagatgatcggatactttatgcagtttattttacagcggagaaaacagccgcaaaatgatttaatcagccatttaatttcagctgatttagacggagagccgctgtcagacaagcaattaatcggtttttgcggcttgttgatcgtcgcggggcacgtaacgacggaaaatgtgatcggaaattcatttctcagtctcaaggagttcccgcatattctgccccggctgcttgaaaataaggcgctccttcctgactttattgaggaagtcatccgcctcagaccttccattcagcgggtaacccgctacaccgcggttgagagcgagattggcggaaaaacgattccggccggagaaaaagtatatgcgtggattggatcggcgaacagagatgaaaagaagtttgaaaatgccgatcagattgacttgggacgaaagccgaatcagcacctgtcattcggtcagggcagccattattgcttaggagcgccgctggcccggcttgaagcgaaaatcgcgctttcccacttttttgaacagatgcccgcatggcgttttactgaggatcaagagccgaatctggttccgagccctgtatttcacggcgttgacaggctgcttgttgagttttgaacgaaaaaataaaagaggcttcgcgggaagcctctttactctgggggcttggagaaatgaatgtaggaatcgaagcaatgaacgtgtttggcggaaccgcgtatgtagacgtcatggagcttgcggaacatcggaacctggataaaaaaaggtttgagaacctgctgatgaaagaaaaagtggtggcgcttccgtttgaagatccgattacgttcgccgtaaatgccgcaaaaccgattatcgattctctgtcagaagaggaacggaatcagattgaaatggtcattacctgtacggaatccgggattgattttggcaaatccatcagtacatatgtccatgattatttgcagctgaagcggaattgccggttatttgaggtgaagcaggcttgctattctttaacggccgggtttcaaatgggcgtgaatttcatcttgtcgcaaacatcgccgggagcgaaagcgctcatcatcggaacggatatttcccgctttttagtggctgaaggcggtgacgcgttgacggaggaatggtcctatgccgaaccgagtgcgggggcgggagctgtcgcgcttttagtcagcagcactcctcatgtctttttgcttgatcaaggtgcaagcgggtattacgggtatgaagtcatggatacctgccgcccgattccggatagtgaagcgggggatgctgatctgtcgctcatgtcttatttggattgctgtgaaaattcatttcaggaataccgaaagcgtgtgagcggggcggattataagaatacatttcaatacctttcttttcatactccgtttggcggaatggtaaaaggagcgcatcggacgatgatgagaaaattggcaaaggctaagccgcaggacattgaagcggattttcagcaacgcgtgctgcctgggattcaatactgtcagcgcgtcggcaacatcatgggggccaccgtatttttatctcttgccagcacgattgataacggctcttttgaaacgccgaaacgcgtcggctgtttttcatacggttcgggctgctgctctgaattttacagcggtgtcgttatgccgcaaagccgtgcgcggcagaatcaatttcagatcagccggcatttggatggacgcgtccgtttatcgatgactgattatgaccggctgctccaagacagcggcatcgtaaaattcggcacaagaaatgccgcgcccgcagcagacatcccgaatgcgcatcaaggaaaaacgcgattagtgctgactgaaataaaagagtttcacagaaagtatgaatggacgacctagtataagagccggaaaggcttgagtatttttaaagaaacggagaatacacatgaatccaatgattgatgtacaggaaacagaaccgggcattgtgcaggtcacaatgcaggatacggccgggaaaaacgggctgtcagaagagtttgtaagagagctgcaccgggtattccaagacatcaatgcccatccgtcctataaaactgtccttctgacgggttacggaaattatttctgcacgggaggaacgcaggaggggcttttgaccattcagagcggaaagcttcaatttacagatttaaagcttcacagtcttttattggattgcaggatccctgtgatttccgtcatgcaggggcatgccatcggagctggctttacgatcggtctgagctcggatttcgtcattttaagcagagagagtttttattcttgtaattatatgaagtacggatttacaccgggaatgggcgcgacgtatattgtgcctgaaaaactgggaattgtcctcggggaagaaatgctgtttacggccgcgaatttcagcggcgccgctctggaaaaacggggtgttccgtttgaagtgctgccgaaaaaagacgcccttcaaagaggccgcgaattggcccggctgctggcggataaaccgagagcctcactggttgcgctgaaaaccaatgtgaccgcacggatcaaaagagagctgacaaaagcggttgaggaagaggtaaacatgcacgaagccacattccatcttcctgaagtaaaagagagaatcagccgcttatacggcagttaaacagaatgaaaaaagcatgggatgcccccatgctttatgactggtccgtcttttgcagaacggagcctgcgaattgttctttaatttcggcgctccgggctgcggtttctgcgatgcagtgcatgatggcttcttcaaagcggcgctcgtctaatgcgcgaaggcctgcttcagtcgtgccgcccgggcttgtgatttccttacgcaggcgttcaggccgtttgctgcttgttctgagcatttccgtcgccccggccatggtttgtaaaatcagctcttttgccgtttcttccggcaggccggcttgaagggcggccttttccatcgcttccacataccggtacacataggcgggaccgcttccggcaatggctgtgacggcatcaaggtgtttttcttcaaagagcgtcgcttctccgattgtttccagaagctcttttgccgtccggatttcagcttcactcgcctcggagcttgcggaaaaaccggtcgccgattgctgaatggccgcggatgtattcggcatcgcccggatgatggtgagctttctgccgaaatattgctgaatcgtgtgaatcgtcagccccgcgatgacagaaatcacaagctgatctttcacgtattcgcgaatgttctcaatgctttctgccgcatctttcggtttaaaggcgagaacaataatgtcggtattgctgaaaaactcttctttatcccggcacggtttcactccgtacgttttttggagctcttcaagccggctgtcatttgaccggtttgtcatatatatatgtccgggggctgtcattccgctttgcagcagtccgttcaccattgcttccgccattgatccggccccgataaaaccgattttcttcatataaatcctccttcttctaaaacacaaaaaaaccttcccgtcaaaaaggacgaaaaggtttcgcggtaccaccttacattagcacgaatcagccgtgctcagctcaaatcccgtaacgagggatacgtttaggttttcctaaccgctctgagggcaggttctgtaaacaagagggccgcaatgtctttcagccggggacattgctctctgctgccgttgtttatatactagttcctcgtcatcgcgttccgtgttttctagtttgttgttcattatgctatgcgaaagagcgggatgtcaatctttttttccgatatgcgcaataatgacacagtgaaaagaaaacgctaaaatatgattattcaggaatgaaaagaacgaaggagcgtaaacatggcagcgagaaagatcattccgatacgtgtgccgactccgtttgcagtcggcgacgttatcgtttatttaataaaagatgaagccttaacccttattgactgcggcccgaatacaaaggaagcggctgaatcgctctcatttcagcttaaggaacacggcgtttctgcggcggatatagaacaggtggtgctcactcatcatcacgcagatcattcaggtctgctgcaccttttttccgaggatacggaagtgatcgggcatccgctgaatgacaggtacattactcaggatcagtcgtatatcgcccggcaggaggacttttttctgtcgcttatgactgaaatgggcgttcccctgacgcctgaagacatacagaaaacagttaagctgtcgtacttattttctgcaaaccgtctgttaacgaaaacagtggaagaaggcgggaaaatcgacgggcttaacggctggacggtgctcgaaatcccgggtcatgccgcttctcacattgcgctctaccatgaaaaaagcggtgaaatgttcagcggcgatctgcttttgtccaacagctccaccaatccgattctggaagctccggaaaaggggggcgtgcgcgcggccccgatgctcgactacttgaactcaatgaagcggctgtatgacgtaaacccgtcccttttatatccgggacacggcgatctgctgacggacgtaaagcctgcttttgacaggcggcttgaaaaacagagaaaccggtcggaatatgtgctgcgcctgttgtcagaggaaacgctgacggctttccaggtatgccggcggctgtttccggctgtgtatgaaaatgaattgtttttaatgatgtcagaaacgatcggccatcttgacgtactggctgcaaaaggggaggctgaatcctttcagtcgggaaatactctgatgtttaaagctgtgaaggggtgaaggaaatgggcagattaacggataagcggatttggatcaccggagcatccggcggactcggagaacggcttgcatattcctgcgcggcagaaggggctcatgtttttttatccgccaggcgggaggaccgcttgcaggaagtgaaaaaaacgattaccgcgcgcggcggacagtgtgatgtcattccgtttgacgtccggcatgcagaagaggctgaaaacgtaaggcgtttgatcggtcatgttgacgtattaatcaacaacgccggcttcggtatttttgaaacagccgctgattcatctttggaggatatgaaggcaatgtttgaagtgaacgtcttcggattaatcgcctgtacgaaggcctgtcttccggtgatgcttcatgcgaaaagcggccatattatcaatatcgcctcacaggccggcaaattggcgacgccgaaatcaagcctttattccgctacgaaacacgccgttttagggtattccaatgcgctgcggcttgagctggccggtacgggtgtagccgtgacaacggttaatcccggtccgatcaaaacagacttctttacaattgcagataaagagggcggttatgtgaaaagcgtcggcagatggatgcttgatgccgaccatgtggcagagcgtattacatccgtaattctgacggataaacgggaaatgaatcttccgcgatggatgagcctcgggacgaagctgtatcagcttttcccttcgtttacagaaaaactggccggccgcgcattaaagaaaaagtaacaagggggagaaaggaatgtccgacctggatatacacaaggcattgatgacagagcctttagtcaggcaaatggcagaggcgcgtgaagtattttggatcaacccgcataaaaccgatgatccagtaaagaatggcgctgaatggagaaaggagattgccgaagcggaagaaaggctgcgccggtttgcgccttatatcgcgtcggcttttccggagacggaagcggcgggaggcctcattgagtctccgcttgtcttcatcaatgaaatgaaaaagcgtctggaacaaagcgccgctcaggctttccccgggcgtctgcttttgaaatgcgacaatgaacttccgatttccggttctattaaagcgcgcggcgggatttatgaagtgctgaagcatgctgaagatctcgctttaaaagcgggaatgctctcaacagacgatgattacagcatattgactgaggaacggtttaccgcttttttctcaaaatactctatagccgtcggttctacgggcaatttaggtctgagtatcggcataatcggcgcgaagctcggcttttgtgtgaccgttcatatgtccagtgacgcaaagcagtggaaaaaggagctgctccgggaaaagggggttcgcgtcatcgaatatgaagcagactacagtctggctgtcaaagaggggcgcatgcaggcgaagcaggacccttattgttattttattgatgatgagcattcccgggatctgtttctggggtatgccgttgcgggaagccgtgtgaaaaagcagctcgatcaaatgaacataaagccgggtgcagatgaaccgcttttcgtttatttgccgtgcggggtcggaggaggcccgggcggcgtcgcgcttgcgctaaagctgatctatggcgggcatgtccatatttttttcggtgagccgacgcattcaccctgtatgctgttaggactgttttccggcttgcatgacggaatcagcgtgcaggatatcggccttgataatcaaacagccgccgacggacttgcggtaggaaggccgtccggactggccggccctctgatggagcctgtactcagcggctgttataccgctgatgacggcacgcttttttcactgctttatcaattaagagcggccgagaataagagccttgaaccctctgcactcgccggtatggccggagccgtcaagttcgttcagaccgaagccggtaaccgttatataaaagagcgggggcttgagatggaaaatgccgtgcaccttgtgtggggtaccggcggaagcatggttcccaaggaggaaatggaagagtacagccggatcggttcctcatttgtgaaaaaaatgggcagacagtgaggcggttttccgttacaatctttgtaagcgtttgttttttaatcggaaagccatacagagagattggtgtgaattgtgaaaagtaaagaattgaacttacatacattgtatacgcagcacagccgcgagtcgtgggccggattcggcggccatctttccattgccgtttcggaggaagaagccaaggccgtagaggggctgaatgactacctgtcggtggaagaagtagaaacgatttatattccgcttgtgcgactgctccatcttcatgtcacgtctgccgcaagacggaatcagcatgtcaacgtgtttctgaaacatccgcattcagcgaaaatcccgtttatcatcggaatcgcgggcagcgtcgccgtcggcaaaagcacgacggcgagaattttgcaaaagcttctttcccgtctgccggacaggccgaaggtgagcctggtgacaaccgacggtttcttgtatccgacggcggaattaaaaaagaaaaaccttctgtccagaaagggatttccggaaagttacgacgtgaaagcgctgcttgagtttctgaacgatataaagtcagggaaagagagagtggaggcgcccgtatactcccaccttacctatgacagggaagagggtgccgtcgaggttgtcgaaggtgcggatatcgttattatcgaaggaatcaatgtcctgcagtcgccgaccttagaggacgacagggaagatccgcggatttttgtatcggatttctttgatttttcgatctatgtggatgccgaagaaagccggattttcacgtggtatttggagcgtttccgcctcttaagagaaaccgcttttcaagatccggcttcttattttcataaatttaaggatttgtctgatgcagaagcggataccatggccgcctccatctgggagagcgtcaaccgtccgaatctgtatgaaaatatcctgccgacaaaattcagatcggatttgattttgaggaaaggtgacggccataaagttgaagaggtgctggtaaggcgggtgtgatgtgaggaggaagcgaatattatgatgcatcatattgaattgtatgtatctgacttgaaagcctccgcccggttttggggatggtttttaggtgagctcggttatagggagtttcaaaattgggactccggcatcagctggaaaaacgccggattttatgttgtgcttgtacagacagaggagcgttttttaacaccggagtaccacagatgccgggtcgggctgaaccatctggcttttcatgctgcgtcaagagagcaggttgacgggatgacggaaaagctgcttgccagaggatgccccgtgctttacagggaccgccatccatatgcaggcggaagcacgcattacgccgtatacacggaggacccggatcggataaaggtggagctggctgcgcctgcttctgaatgaactataacttctcgtttttttcttcgcgcagcgcgtcgagtttcttttcgattctgtccaattgtatgcggcgctgcttcaagcttctgaatacgtatatcacggcaaacaggaaaaatgcggctgcaataaatgagatcaattgaaaaatgacatcaccgatgttcatcttttttacctccgtgtgcggcgggcttcttcagcccgccgttttttcattttaaccgatgtgaagacatgggggatgaatcatttctctcctagctttgtttctttctgagaatgaatagtttctgcatatggcttatgatcacttttgcggccgcatatcccggaatggccagcagcatcccggcaattcctgagaatttgccggcggcaagcagaagaaaaataatggtcagcgggtgaatgtccagcttccgtcccataatttgcggggaaatcagctggctttcaagctgctggacaatgacgacgaccgtaatcaccagcaccgcctcggtcggtgaatcgaacaatccgacaatgactccgggaaatgtgccgatccaaggcccgataaacggaatcagatttgtcaccatggcgaacgcgcccagaacgagcggataatcgagcccgatgataaaatagccgattgtgacgagaacgccgacacagaaactgacgagcagctgtccttgtatgtatgaactgagagcttcatccatatcccgcaggatttgttttccttctttttgatgtttttccggaagaagccgcagcagtcgccgggggctttatttccttcttttaacatgtaatacagcgcaaacggaataatggctgcggtgatggcggcattggcagccgtaccggccagactgctgagagaatcagcgattgaaccggaataatttgcggctttgtccgctaattttttaaaggaatccccatgctgaagcctggaaaaccatttgctgtcctgaagatgcccgatccaattttcagcttttgcggaaagctccggaatatggtctgtgaaggctgtaaactgtttttgaacggcagggcccgccgtataaaggaagaggacaaaaaggccggctgttcccgcataaatcgctaaaatcgcgattccttggggcagctttaatttcgcatgcagcactctgacgagcgggcggcacaaatagtaaaggacacccgataatacaatgggcggaaacaaggttttaaccgtaatcacaacaggctggaacaaaaagtctattaatgttccgagataaatgatgagaaataacagaagaacggcatagccgatcttgaaataaggcccgacaggcatatcctgcaccacgcaatctttagggtttactctcggacgtttcccttttcgcccggtgcataaacgtccgtgtcaggaaaactgcccctgattggtgacgtaatcgtagataatatcttctacatgggcatggagatcctcatcgggttcttcattccttctttcttctaaagctttttttaaactctgtttttcataggggctcagcggatctgtcgacacattccgtccatactggcggagggcttgtcccagcattttttctataaattgatccatcatatattctcctattcttgtcattcatctttattctactaaatatcatgtgatcctcccactcttctatcatattttctgtcaggacgatttaggcttttattccagttcagccgagagaataagatgaaacggcagcgttaacgcatcttcatcgtttatgatttttaaacgtttttcgtcatgcctcacttgtttcacccatccccaaaagcggcgggggccgcgtgctgaagcataggtgaccgagatggctctgtcttcttcaatcgacgccgcaatgatgcggttcatgtcgttcagttgctctgcgctcagttccggaggccggaattcccgttcttttcgtttttttgcaagcagctgctcccgatgttcgggcagcatcatccggcttgattcccacatgacattatacccgggtgttaatttgttcggattcatgtatatcacctcaattatttgtaatgcccgccgattttttcagcccggtgaaaggcttggccggcctctgtcagcgaagcggcatggaggagcgacgcagggccgtaccgctcatgaatatcatccaatactttgccgagactgatctttttttcctgagcatcaaacaggctcagctgaacataatcacagggctccagctgggaaagggagacgccggcgctgcggacgggctcaccgttccaatgctctttgaagagcttgaccgccgctttaaaaatatccattccgaaattagtcggagagaccagctttctctgtctgtgaaaacctgaagggaattcaaaatcagcgcctctgatgctgaccgaaaccgtatggccgatgtattgtttgaaacgggcgcggcgggccacttcttcgcttaactccaacagcacgactttgatatcctcaaagcggctgtagtctctcgggagggtcatgttatggccgatcgctttttgccggctgtgcgtgttgacggtgaccggagagggatcgatgccgcgggctgtccgctgaagcaattcgccgttaatgccccagcgttttttcagcagttcggcggggtgcccggcaagcccgccgattgtgctgatgcccatccgtcttaaatgatgctccatccgttttccgatgccgaataattttccgaccggcagcggccacagatcctccctgatatttgacatatccaatctgtggatgccggatgcgttttttttggcaaaatggtcgcaagccattttcgcgagcgccttattcggcccgatgccgacacgggcataaattccgaattcacgcataatcgcttgctgaatgctttcggcaattgtaaaaggatcaccgaacagccgcctgcttccggtcacgtcgagaaactgctcatcgatggagtagggttctacaagatcggtataccgttcaaacagttcggtaatcatgacggatacatcaatatactgctgcatccgcggacggacaataacggcgtcgggacatttggcctgcgcttcccacagccgttcggcattttttacgccgtatcgtttggcgagcggacaagccgcaagcacgacgccgctgcgtctttcgggatctcccgagacaatcacgggccggcttttgagatgaggcgcttccgctttttccacagacgcataaaacgattgcatatcaacaagaagaatatcagccataaaaaaacctccgggaacgtttgttctgtttttcattgtacccgaacaatgatcacgtttatactggtaaatcattccccggctggaagacgtgctgattcgtttgcttgaaaagaaatcatttacaattgcaaacaacccacatataattttttatattccaatgagaagagctgacattcattttgccggacgaaaaggagagtcaatcgataatggatattcgaacaattacctctgaagactatgaaatggttacgtctgttttgaatgaatggtggggcggcaggcagatgaaagacaaactgccgcgcttgttttttgaacattttcaggacacgagctttatcacgtacgggccggagggaatgaccggttttttaatcggttttcagtcacaatcagaccctgagacagcctacattcatttttccggtgtgcatccggatttcagaaaaatgcaaattggaaaacagctctacgatcgatttatggagacggtgaaaaaaaggggctgcacaaaagtcaattgcgtgacggcgcccgtgaataaagtatcaatcgcttatcatacaaaattaggctttgaagttgaaaaaggaaccaaaaccgtaaacggaatccctgtttttgcgaattatgacggtccgggagaagacagaattctgtttgtgaaatatatgtagagggggatgaatatgggttttttagctgacacgcccaaaccgccctattatgcggtcattttttcatcaataaagggaaaatatgatgaggaatatgagcatacggcagagcgcatgatgaatttggcaggcggacagccgggctttttaggcgcggaaagcgttcgggaggaaaacggctgcggcatcacggtttcctactgggacagcctggaggcgattaaaaggtggaaagaccatactgaccaccgggcggcaaaacaaaaaggaaaaagcgcctggtatgaagcgtacgcggtccgcattacgaagacggagtcacagcggatgtttgcgtcaaaaggggcggaagattgattacatttttacggcatacacaagaacagacggcgcgggaaattgcggcggttcaacgctgctcttatcaaaaagaagccgagctgatcggctttttcggcattccagccctgcatgaaacacccggtgacatacagcggtcacgggagacgtttgccggtttcagagaaaaagatcggcttgcaggcgtcatttcgtatgaaaaaaaaggatatgaccttgtcatatgcaggctgacggtgcacccgtccggctttcggaaaggaatcggacgggcgcttattcaatttgtgatcgaccaaaaccgggacgcccaaaaaatagaggcggctaccgccagtcaaaacgttccggcagtctctctctatttaaaaaccggcttcacagaagccggacagacagagacgccggaagggctgaccctctcgttttttcatctttatccgaagaggaaagcggaagttgttccgtacaagccggaatggaaagagatgtttgaaagagagaaggcggacttgatccgaatcttcggccccgcacttcattctgtcagccatatcggcagcacctccatcccgggaatggccgcaaaacccgttatcgatatactggcggaggtcaaagatatttcagatgctgaccgattcagcccgcagctggaagcactcggctatgaggcgcaaggggaaaacgggatagagggccggcgtttctttcaaaaaggcggcagcaagcgcacacaccacgtccacatatacgaaacaggccatccggatgtgaagcgccatctgctgttccgggattacctcactgaaaagcctgaaaaagcggctcaatacatggaactgaaacggcggctcgctaaggcatacccgtacgatacggcaaagtatagtgaagggaaaaatgactggatcaaggcggctgaacaagaggcaaaggactgggagagcgggcttctgtaaagaaagcagaaacaatgcatacagcggctcggtatgctacaatggcgaaaatgaaaaacggaggatcatctatgcaaatacatgtgacggatgcggcgaaacacacacttcagcaggcgatggacgccaacccggggaaaaaagcgcagctccgctatgacgcagaaggctgcgggtgcgcggtgagcggcgtgccgaccatctggctggcggacgaattaacgggacaatgcgaagccattgaaaccaacggacttccgctttacatccagacctcacaaaaagtgttttttgacgaggaaatgacaatcgattacaatgaaaaggcaaaaacgctcgtcttaaaaagcccggcagagatgctgagcccgagaatgagcatattagtaaagcagggagaaacggaaagtgaatcaaaagctgaaagccattaaacagacggcacagcataaaacgtgggtatcctttctgaacaacaaccacccgtacagtctgctgcactggtccatcggaggcgctgaatccgttcagaaggatgtctggctgcttcaggatgagatgaccttcaaagcgcaggagtttacgacaatcgacctcgccattgactggatcggagaaaatatggacgggattaccgacgttttatgacgggaaagcgaaagaaccagcatacgttctttcgcttttttacgtttgcgtcatggtatctaaaaaggtttgaacggctttgcggtagctctccggatttttggtgtacgacatggcatgcccgcccgattcggccagatagagcatcttcggtccgcgttttctgcggtgcagcaattcggaagaagcgggaggtatataatcatcttccttactgtgaataaacagcacgggctgccggtcggctgataaccgatagaggcgatacatcacggatacggtatccttctctcatccgcaaaaagaaatcagccaaaggcagaagcggccacggaggcagccggaactcccgcttcagtctgtaggcgagctgatcgcgaaagcttgcgaacggacagtccgcaatataaaaatcagcgcctttttcatcctgatgcccgcccgcgtataataaggccgtcaccgctcccatcgattccccgtggatgccgatttgaccgccgtctcccgttttgtgtctcacccaattcacggcttcttccaaatcatctttttcaaaatagccgtagctcgtcgttctgccgccgctttttccgtgcccgcggtggtcatatacgagcacattccagcctgaatctaaaaataaatccatgtatttcaatgaattgaacgaatttacggtaacgccgtgacaaataatcatggcgtttgccgtatgatgcggggcgacgtaaaagcctttgatctcatacccgtggcgtgacaggatgacggcctcttctttttccatggcctgaaaggaatcaaatctatcatgcccgtccgccgtttcttttttcatgatatcttcatccgtctttttcttcataaacataatgagattcgtaaaagcgaatccggcagccaaaaagactgcgcaagccgaaccgaacaccgccagccattttttcacacaggggccctcctttcatatgaaaaatccttcctccggcttttcaggaccgtgaacgttgccggcctccggcgctccgtggtacacttgcttcaccatattcagatacggggggcgtaatgatgaaaaagcagctgcctaaagaaaaacacagcttaaaagacgatctggaggaagatctgaaggccaggcttttgcaaatgaaaagtgagctgaaggaagaagacgagaaaaaacaggcgcagcaaaaagcggaacaaatcagaaagcgaaaagaaaaagaaaaacataaaagctttgaagagctgctgaatgaaagcagtctcgattggcacaaatataaataaaccggcatctgacaaggtgccggttttattgtttaagaacgatgggcttcgtatacgtcccgttttgtatggtattgcagggctttgatttcctggctgcttaaacgccgggcctctgcagccgaacagttttctctcagctgctcaagtgagctggctccggtgatgacagaagcgacggccggctgtgacagtaagtattgaagggaaagctccgtcatgctcaagtcaggtgcggcagcgccgatcgcttttttggtttcttccaattctgcaaaagaatatgttaaatacccgttctcttttacgcttgcggctgcttgatcaagcggtttttccgtaagaagccctttagcgacaggccctctggcgactacgctgattccgttctcctctaaaaggggaagccactcctcaggacgccggtccagcaggctgtattgcatcataacgcttgagatatttgattttttcacatattctttaatgacattcggacgaatcgaggaaatgccgtaataccggatgacgccttcctgttttaagtcctcaaacgcttcgatcgtttcgtcaatatgatcttccatcgtgccgccatgcagctgataaaggtcgatatagtccgttttcagccggcgcagactgtttttgaccgcttcttttatgtatcctttggaggcgtcccaatgccagccgtctttatcatcattccagcggtttccggctttcgtggctaaaatgatgtcgtgcctgcggtttttgacggcctccccgacaatttcctcatttctgccgaaatcataaagatcagcggtatctaaataattgattccaagctcgatcgcttcatccaaaatagacagcgcttcagctttatccgtgcccagcgacatacagccgagcccgatttcgcttatttctaaatcagaatgtcccagtgtgcgttttctcatcgtttcgctcctttttatagtcttttattgaccgtaatataaaggcgcgaagttttcaactgttaaggcccggtgatccaatctccgacatagcggaatgtccgtccgtattctttcagtttagcccgcacttcccacgcctttccgaccaatacgatacttttatccttccggtacaccttcaatcgaaaagcacctccctctcatgcatgtatgataaaatatatgaggcataatagagagacagaacgggagatgacatgatgaaacatttagaagaaaaaacacttgcgaaaaaaaagctgtatgacgggaaagtcatagatctttacttagaggatgtagagctcccgaacggaaaaacaagcaagcgggaaatcgtcaaacatccgggagcggtggccgtacttgcggtgaccgaagaaggaaaaatcattttggtaaaccagttcagaaagccgctggaacggacaatcgttgaaattccggccgggaagcttgaaaagggggaagagccggaacatacggcgttaagagagctcgaggaagaaacgggatatacggcggaaaccttgacgaaaatcaccgctttttatacatcacccgggtttgctgatgaaatcgtgcatctctttcttgcggaagggctttcgccgctggaagaaaagcgcgaactggatgaggatgaatttgtcgaagtcatgcaggtcacgcttgaagaggccgtgaagctgattgaatcccgcagggtgtatgacgcaaaaacggcgtacgcgattcagtatctgcagctgaaagaagcactgaaggaaaaatgatgaaaaccatctatgcggatctgcatattcatatcggccgcacctatacgggaaaaccggtcaaaatcaccggggccaaaacgttgacgctgcatcggattttagaagaggccagtgaggggaagggaattgaactattgggcatcatcgactgccattccccggaagtcatagaagaaatcgagcgcggaattgatgaaggcagataccgtgagctgaaagaaggcggcatccggtatcggaatacgacgcttctgttgggcagtgagcttgaaatctatgatcacacatgccgcgggccgattcacgttctcgtctttatgccgtctcttgccgaaatgaagatgttttctgagtggctcgcaaaaaggcttaaaaatatccatctcagttcccagcgtatttatgaaaccggtttgaatcttcaaaggaaaacaaaggaattgggcgggctgtttattcccgcccatatgttcaccccgcataaaagcctgtacggaaaaggggtcatatcttctttgacagaagttttcgacccggcgctcattgatgcggcggaactcggattaagctgcgacaccgacatggcttcgcgggtaacggaacttgatccgtatacatttttaacaaattctgatgcgcattccttaggaaaaatcggcagagaatataatgaaatgcttcttaaagaagcgaatttcacggaattttcgctggctttaaaagggaaggacggaagaaaaatcacggcgaattacgggctgaacccgaagctcgggaagtattaccggacggcttgcgaccgctgcggcagcccggttgaaaaaggagcttccgcctgtccggagtgcggggggaaaactatgacaaaaggggtcagtgaacggctggaggaactgagcggcccgaaaaaaagccgcgtgccgcggccgccgtatattcatcaaatcccgctgcagttcattccgggggtcgggccgaaaacgttagacaaactgaagcgggctttcgggacggagatggcgattcttcatcaggcgcaagaagaggaattggcgcatgtcgtccagcctaaaatagcggctgtcattcataaagcgcgcaccgggcagctcgtccttgaggccggggcggagggacgtacggcagaatcaagtcgtaaaagccggattttagcggagctcctcctgcaccttctttttcgtgcggacaaacgcaatcaattcgatgatttcatcctgattcagcggctgtccgtcaacggtcagtgtgccgcggccttgtgcggcgtttgttaattcgatggtctgggtaaacggctccgcctttttttcagtgcgccccagtaaatcgtcgcacgtcgtgtcaaacagatcggcaagcgtgcccagcgcttcgaatgacggacgccggtatcctgattcatacccggcgtacgtgcttttggcgatgccgagacggtcagccgtatattgaagagaccaatttttcttttttctcagttcagttaaacgatctaaattcatattcaaaaccgctccttttcacttgagcaaattatatcatatcgatatgcaaaagtgtacgcgaattgaataataatcacttgattaatttcaatcgtctgtctataatttgattaaaagtatgcgaaaagcgaatgcttaacacatcttgagaaatggatgaagaggtgcagggtatgaaaaaattattgctgttaacaaccggaggaacaatcgcctcagtcgaaggagaaaacgggcttgcacccggggtgaaagcagacgaattgttaacctacgtatcaaaacttgataacgattacacgatggaaacccattcgttaatgaacatcgacagcacaaatatgcagcctgaatactgggccgaaatcgcaaatgctgtcaaagaaaaatatgacgcatatgacgggttcgtcattacgcacgggacagacacaatggcgtatacatcagcggcactgtcttatatgcttcagcatgctgataaaccgatcgtcattacgggttcgcaaattccgattacatttcaaaaaaccgatgccaaaaaaaatatcacggacgcgatccgcttcgcatgtgaaggggtgggcggcgtatacgtcgtatttgacggcagagtcattcaaggcacacgcgccattaaattaagaacgaaaagctatgatgcatttgagagcattaactatccgtatatcgcgtttattaccgaaaacggaattgaatacaacaaacaagtgcacatgccaaaagacgatgcctttacggtcaatacctcactttgcacggacgtgtgcctgctcaagctccacccggggctgaaaccggaaatgtttgacgcattaaagggcatgtacaaagggatcgtcattgaaagctacggcagcggcggcgtgccgtttgaaggaagagacattctcgccaaagtcaatgaaatgattgaaagcggcattgtcgtcgtcattacgacacaatgtcttgaagaaggagaggacatgagcgtctatgaagtcggccgaagagtcaatcaagatctcattatccgctccagaaatatgaacacggaagccatcgtgccgaaattaatgtgggcgctcggccagtctcacaacttggctgaagtcaaaaacattatggagacaccgatcgcagacgacgttgtactgtaaaaacatgactaccacaaagagaaagtagggttttagcatgacaaacgcgcaaaaagaatatcgtcaggaaaaagatttcctcggagaaaaacaaattgaagctgatgtgtattacggaatacaaacgctgcgcgcgaaagaaaactttccgattaccggctaccgcatccacgaagagatgattaatgcgctcgccatcgtcaaaaaagcggcggcgcttgccaacatggatgtaaaacggctgtatgaaggaatcggaaatgcgattgtccaggccgcagacgagattcttgaggggaaatggcatgaccaattcatcgtcgatccgatccaagggggagccggaacgtccatgaacatgaatgccaacgaagtaatcggcaacagggcccttgaaatcatgggccataaaaaaggtgaatacattcacctcagcccgaacacacacgtcaacatgtcccaatcgacgaacgacgtgttcccgacggcaatccatatttccaccttaaaacttttggataagctccttgatacgatggcgcatatgctgagtgtctttaaggataaagcgaaacaatttgattctgtcattaaaatggggcgcacacaccttcaggacgctgtgccgatccgtctcggacaggaatttgaagcatacagccgcgtgctcgagcgtgacataaagcgaattaaacaatcccgccagcatctgtatgaagtcaacatgggggcaacggccgtagggacggggcttaatgccgatccgcgctacatagaacaggttgtaaagcacctggctgacatcagcggactgccgcttgtcggcgccggccatttggttgacgccacacaaaacactgatgcgtatacggaagtttcagccgcgttgaaagtatgcatgatgaacatgtctaaaatcgccaacgatctgcgcttaatggcttcaggtccgcgcgcgggacttgcggaaatttcactgcccgcccgtcagccgggatcatccattatgcctgggaaagtcaaccctgtaatggcagagctgatcaaccaaatcgccttccaggtcatcgggaatgacaatacgatctgcctcgcttcagaagcgggccagctggagcttaacgtaatggagccggtactcgtatttaacctgcttcaatccatcagcatcatgaataacgggttccgttcatttaccgatcattgtctggcgggaattgaagccaacgaaaaacgtctgaagcaatacgtggaaaaaagcgtcggcgtcattacagcggtcaatccgcacctcggctatgaagcggctgcgcgaattgcccgtgaagccatcatgacggggcaatctgtaagagatctttgccttcaaaatgatgtactgacagaagaagaattggatatcattttgaatccgtatgaaatgacaaaaccggggattgccggaaaagatctattagaaaaataaattttaaagcaacaacagccgccttttcacgtttttcagtgaataggcggttgccatacaaagggatgaggcagtatagtataatttgttatatcatttgatgaaagcgttttagcttttttcttctagggggattttcttgtgaaagaggtcagattgccaaatttattggaaattattatcttattattcgggtttttagcacttgtcttatcgttcacagtgtttttagacctgccgatccagctagctctattaatatcctggtttttcgctattattctcggagtcaggctgggatattcatataaagacttgcaggattcgattgtcaccgggatatcaaacggtcttgaagcggtgttgattctcgtttcggtcggtgcgctcatcgggacatggattgccggcggtgttgtgccgacgttaatttattatggtttagagtttattaatcctcatattttccttctggctacactggttatttgttccgttatgtccgttgcgaccggaacatcgtggggaaccgtgggaaccgcggggatcgccatgattgccatcggagagggaatgggtataccgcttccgatcgtagcgggagccgttttgtccggcgcttacttcggagacaagctttcaccgctgtctgacagtacggtgcttgcctccacgctttctaaggtggatgtgctgtcgcacgtcagagcgatgatgtatctgtcaattccgtcctatattattacggccattctatttaccgtaacgggatttatatacggcggaaaaaatattgatctcgacaaagtggaatttttaaaatcttcattgcagaaaacgtttgatattcatatatggatgctcattccggctgttgtcgtcgttgtccttctgattttgaaaaagccgtctatgcccgttattatcatcggtgctttgcttggcgcaatctgggcttccgtctttcagggaatgaattttgccagtgccatcgcgactgcttataatggtttttctattaaaacggacgtcgaatttttaaacggcctgttaaaccgcggaggcattaccggtatgctggatacgttagtcgttatcctgttcggtctcggttttggaggaattcttgagaagctcggcgtattaaaagtgattgtctcaacttttgagaaaaagctgaccacaccgggaaatgtgacgctttcgacattgatcgtcgcccttttaggaaacattttcggctgtgcgatgtacgtgtcattgatcctgacgccgaaaatcatggagaacagttatgataaactgaaacttgacagaagagttttatcccggaacgcagaggtgggcggaacgcttacttcagggatggtgccgtggtctgataacggcatctatatggccggcattctcggcgtatccacattttcatatctgccgttcatgtggctcagttttgtatctatcggactggcaatattgtacggatacacggggaaattcatttggtacacgaaagaaaaatccttgcaatctcaaaaattgggttaggaggttcatttcatgattacaaagcatatgattcggacgttaatgattgaaacgccgactgttcccggaaatctcggaaaagtggcaaccgccatcggagtgatgggcggagatatcggggaagttgaaaccgttaaagtcggcccgaactacacaatgcgcaacatcacggtgcaggccgaaaatgaggagcagctgcaggaaatcattcaagccattgaagctctcggtgaaggcatccggcttcatacagtctcagatgaagtgctctctgctcatgaaggcggcaaaattcaaatgaaaagcaaaatgccgatccggacattggctgagcttggccgtgtttatacaccgggcgtcgccgatgtgtgccgactgattgaaaacgagcctgaaaaagcgtccatctatacgacaatcagcaattctgtcgccattgtcaccgacggcacggcgattctcggcctcggcaatatcggttctgtcgccggaatgcctgtaatggaagggaaagccgcgctttttgaccagctggcgggtatcagcggaattccgattttgcttgatacctctgatccggaagaaattattcgcacggtaaaacatatttctccggggttcagcggaatactgcttgaagatatcggttcgcctcactgctttgacattgaagaccgcctgaaagaagaactggatattccggttatgcacgatgatcagcacggcacggcggtcgtcacgctcgccgccgccatttccgcttgtaaaagcgccggtcttgatttaaaagaagcgaaggtcggacagatcggtctcggcgcggcaggcgtcgccatctgccggatgtttatggcatacggagtcaaagcggtctgcggaacggacaagtcagaagacgcaatgaaccgcctcgctcagtacggaggtcagccgcttggaagcatcaaagatttaatggacacgtgtgacattgtgatcagcaccaccggagttccgggtctcattaaaaaagaggatgtcagaaaaggacatgtcattctggccttatctaatccgaagccggagattgaaccggaagacgcattacaagccggagccgcttatgcagccgacggccgctcggtcaataatgttctcggcttcccggggattttccgcggcgcgctgaacgccaaaagcaagaaaatcgaccatgaaatgcttgtggcggccgcagaagccatcgcctcttgcacaaaacacggcgatctcgtgcctcagcctttggatgcggacgtgcatcaggctgtatcagcagccgtagaacgggccgcggcaggaaaataaacaactcttacagtaccggacatgtgccggtgctgtttttttagatgaataggaaacggaattcttaggcaggctaacagatagcaaaagacggaataaagaggtgtcaatgtggattattttccgctgatccatacaaatatttgggatgctgtgatcggcgtgccggtcgtcttatgcgttacacagctgatcaaagtgttctgccgggttccgggcatattcgttcccacgattgcccttgctgccggaaatgttgtgtctatcgttttcggtcaccatgaacacgtgtatgcggggattttcatgggatttttttacggatacgccgctatggggagctattcatctgccaaaacgtctctgcgcgcttaccggtcgaaacatgagccgtattcatgaacacatcgggatttttttgttatgataaagaaaaggcaaaaaggagcgattggcacatggcgaagagcaaaacgaaaaaaatgcgggagcatctcagaagaaacgggatgcgtgacgcagtcttgtcaagggggacggcgccgcctttcagcacccatgaaagagtgacgaaaactaaaaaagacaggcttgaaagaataaagcataaaaaaaggaacccctatgatcaccggagtgatgacgggggttctttttttatgcccgaatctcgcgcctttctatgatttctctgtcatgttttctcttttctttcatacaatctactaaatcaagtcaatagattagcgggaggaaagcggtatgagaaaacaatcgtacaaagaactgttttttcgccatgtaaaggatcatctgtcactttatatatttgtgttcgtcttgtttttgatgggggtcattttcggggcgatcatcgtcaacagcatgaccatcacgcagaaagaagatttgtattactatttaagcaagtttttcggacagctgtctgacggaaaacatgccggcgcttcagaaatgttttggcaggccgtctttcatgatgtaaaatatttggggctgatgtggattctcggtatttccgtgatcggtcttccggttattttcattatggtgttcttaaaaggaatcgtcgtcggcttcacggtcggttttttagtgaatcaaatggggatgaacgggtttttcctgtcatttatttcggttctgccgcaaaacatcgttctcattccagcatatcttatcatggggacatgctccatcgctttttcactgaaactgatccggcagctgtttgtcaaacgcagccttcatgacgcgccgatccaatggttcggacgctacgccttcgtactgattctcatcgttttcttctcggtcctcgcttcactgctcgaagcgtacatgtctccgctgtttatggaaaagctgtcatcacgcatattttagaattattatcacaaaataatacttttatttatcagtttataataattatagttggaactctgcgcgtattttgttataatgagtcatggaatgcggcgtaggagggaaagacatggaaaaccgtattgatcgaattaaaaagcagctgcactcgtcaagctacaagcttacgccacagcgggaagcaacggtaagagtgctgcttgaaaacgaagaagaccatttaagcgcagaagatgtatacctcctcgtaaaagagaaatctcctgaaattggtctcgctacagtataccgtacattagaattattaacagaattaaaagtcgttgataaaattaacttcggggacggcgtatcccgctacgaccttcgcaaagagggcgcggctcattttcatcaccatttggtgtgcatggagtgcggagccgtcgatgaaattgaagaagatctgcttgaagacgttgaagaagtgattgaacgtgattggaaatttaaaattaaagatcatagattgacttttcacggaatctgccaccgctgccgcggggatgaaacagagtaaaagcctatgaaccttttctgccaggaaagggttttttgctgtttttatgtataaaagcctttgaaattggcataaggtgtactaacagccgccaaagaaagggtcgatcgaaagatgggcagattcctgaaaacagccgcggatacgatcaaagtgtttattctgttcacaggttttaccgcgctgttctattatgctatgatatgggtgaattcagagtatgaaaactatcatcggtacgataaaccggaaggctccgccgtcaaagtggccaaaacggaacatgaggagaaagacggctggttcggccgattgatctttttttaccaaaacggggagtagatcaagagtgaaggatcaaattaaggatttcatccattatgtgagggttgaaagagggctgtccctaaatacgatgatgtcctatgagcgtgatctgaaaagttattctctcttcttaactgaaacccttcagatcacttcatggaatgatgtgacccgtcttcatattattcaatatttaaagcatataaaggactccgggaaatccggcaagacgtctgccaggcatttggcgtcgatccggtcttttcatcaatttctgttaagggaaaaagccgcggataaagatccttcggtacatattgaaacacaaaaaacagagcggacgcttccgaaagtattggcgcttcacgaagttgagcggttattggacacgcctaagcttgacagcccgttcggtctcagggataaagccatgcttgaactgctgtacgcaaccggcatccgggtcagcgagatgatcgagctgaaattatccgacgtccatttgacgatgggatttgtccgctgcttcggaaaagggcggaaagagcggattgtgccgattggtgaagccgcttcccatgcgatagaagcatacattgaaaaagccagagggaaattattaaagaaaaacgtaaccgaagcgctttttctgaatcatcacggcaggcagatcagccgtcagggattctggaaaaacctgaaaaaaatcgcccttgaagcggggattaaaaaagagctgacaccgcacacgctccggcactcttttgcaacgcacctgctcgaaaacggcgcggatctgcgcgccgtgcaggagatgctcggacatgccgatatttccacgacacaaatttatacgcatgtgacgaaaacaaggctgaaggacgtgtacaaacagtatcatccgcgagcttaggagccgctgccagaggggccgcggctttttttgccggattggcggaatacagagaaggttctaattatttgaatcggcattgtcaacaagaatgtaaacggtttatacttgagttgtctgacctctgtaagctacaatggacagatggaagaaaaggaggcttttatgatgtctgaatacaaatataaccgggtatttttaattgtaatggattctgtcggaatcggtgaagcgccggacgccgccgattttaatgatataggcgcaaatacgctcggacatatcgcagagcacatgaacggcttacatatgccccatatggcgcagctcggtctcggactgatcggagacattaagggcgtggaaaaaacggagcaccctcttgcgtactacggaaaaatgcaggaggcgtcaaacgggaaagatacgatgacggggcactgggagattatgggcctctacattgaaaaaccgtttaaagtgttcccggaaggattcccggatgaacttcttcaggaacttgagcggcgttcaggacggaaaatcatcggaaataagccggcttcaggcacggcgattctggacgagctcggaaaagaacatatggaaacgggtgcgctgatcgtttacacatcagcagattccgtgctgcagattgcggctcacgaagatgtcgttccgctggaagagctgtacagcatctgtgaaacggccagagaactgacgcttgatccgaagtacatggtcggccggattatcgcaagaccgttcgtcggagagccgggcagcttcaaacgcacgccgaaccgtcatgattatgcgctcaaaccgttcggccgcacggtaatgaacggaatgaaagacagcggattagacgtcatttccatcggcaaaatttctgatatttatgacggagaaggcattacatcttcccgccgcacggtatctaatatggatggcatggacaaagtgattgaaacgctcggtgaagagtttacgggcctgagctttgccaacctcgttgattttgacgcgctgtacggacaccgccgcgatccggaagggtacggaaaagcgcttgaggaattcgacgcgaggcttccggaagtgtttgaaaaaatgaaagaagacgatctgcttattatcactgcggatcacggcaatgatcctgtccatcacggcacggatcacacgcgggagtatgtgccgcttcttgtttacagcaaaaagcacaaacatacagaacagctgccgcttgcggatacatttgccgatatcggcgcaactattgccgataattttaaaacggaaaagccggaatacggaaaaagctttttatcaagattacagtagggggactttttttgaaacaaaagatcgaacgtgctgctgcatttattaaagaacacgtgaaagaaacaccaaagatcggtctgattttagggtcagggctcggcgtattggccgatgaaattgaaggagctgtcaagcttacatatgaaacgatccctgattttccggtctcaacggtagaaggccatgccggccagcttgtgatgggaacgcttgaaggcgtgcaggtcatcgcgatgcagggccgctttcattactatgaaggctactcaatggatcaggtcacatttccagtccgcgtgatgaaagcgctcggcgttgaatctctcgtcgtgacgaatgcagccggcggtatcaacactgaattccgcgccggcgatctgatgattattacagaccatatcaactttacaggcaccaacccgttaatcgggccgaacgaagctgaattcggagcgagattcccggacatgtcagaagcctatgacaaagagctgtcaagcttggctgaaaaaacggccgatgagctgggcattcctgttcaaaaaggtgtgtatacagctgttacggggccgtcttacgaaacacctgctgaggttcggtttttaagaacgatggggtctgacgctgtcggcatgtcgaccgtgccggaagtcatcgtcgccaaccacgcggggatacgcgtgctcggcatctcatgcatttccaacgcggcggcgggtattcttgaccagccgttatctcatgaagaagtaatggaaatgacggaaaaagtaaaaggcggctttttgaagcttgtcaaagccgtagtcgcacgatctcaaaaataagtcagcataagtcagctgtttcttcggaagcagctgtttttttgtgccctcaacacgaaacattttccagatgaggcgtataaaaccaccggatttggaaaaaataaaaaggattatgaaatggagggctttggagatgaaacgtcttatatccactttgttgattggcattttattaacggcatcagcaccgtccgcttttgcaaagccggacggaaaacatacatcggagctcgctcatgaagccaaaagcgccgtgctgattgaacgcgatacgggaagcattctttataacaagaacagccgggagcgtctggcgccggcaagcatgacaaaaatcatgaccatgcttttaatcatggaagcgcttgacaaagggaaaataaagatgagcgataaagtcaggacgagtgaacacgccgcgtccatgggcggatcacagattttccttgaacccggagaagaaatgacggtaaaagaaatgctcaaaggaattgcgatagcttccggaaatgacgcatctgtcgcaatggcggagtatatcgccggttcagaagaggatttcgtcagccggatgaacaaaaaagcaaaagaattgggattgaaagatacctccttcaaaaacccgacaggactgcctgaaaaagaccattacagctctgcttatgacatggcgaaaatggcgaaggaattattaaagtacgataaaatcactcaatttacgggaacgtatgaggattatttaagagaaaatacagacaaaaagttctggctcgtcaatacaaaccggctgatcaaattttacccgggtgtagacggcgtgaagacgggctttacaggcgaagcgaagtattgtttaaccgccaccgctaaaaaagggaatatgagggtcattgctgtcgttttcggagccagcaccccgaaagaaagaaacgcccaagtgaccaaaatgcttgattacgccttcagccagttcaaaacacacccgctgtacaaacggaatcaaatcgtcggaacggtaaaagtgaaaaaaggaaaacagaaactgatcaagctgaccacatctgagccgatttctcttctggccaaaaagggagagaacatggacaaagtaaaaaaagaagtgaaaatcaacggcaatgtaacggctccggttaaaaaaggagaggtgctcggcagcctcgttctgaaaaaagacggaaaggtgctcgttgaaagcccggtcacggcaaaagacgacatggaaaaagcgggttttctcacttttctgaagcggacgatgggagattggacaaaatttaaataatcatggcgaacgggcactagttttgtcatagtgaaggaattgctttcccgaaaatcgaaacactcattatccgatcatacaaggaggaatgagcatgagccttggaattgactttcatgtcaaagaatccgtgctttgtattcgattaacaggtgaactcgaccatcatacggcagaatcattaaaacaaaaggttactgaatcgctggaggctgacagcatccgtcacattgtgctgaaccttgaagatcttaccttcatggacagctccggcctcggcgtgattttagggcgttataaacaaattaaacagctcggcggagaaatggtcgtgtgcgcgatttcgccagcggtgagacgtctgtttgacatgtccggcctgtttaaaatcatcaggttcgaacaatcggaacaaaaagcgcttttaacgttgggggtggcttcatgaaaaacgagatgcatcttgaattttcagccctcagtcagaacgaatcgtttgcgcgcgtaacggttgcttcttttatcgcgcagcttgacccgacgatggatgagctgacggaaatcaagaccgtcgtatcagaagcggtaacaaacgcaatcatccacggctatgaagaaaactgcgacggaaaggtgtacatctccgttacgctggaggatcatgtcgtctatctgaccatacgtgatgaaggcctcgggatcacggatcttgaggaagcgcgccagccgctctttacgacaaaacccgagcttgagcgctccggaatgggctttaccattatggaaaactttatggatgatgtcacgattgattcctcgccggagatgggaacgacgatacgcttaacaaaacacctatcaaaaagcaaagcgctttgtaattaaggagatttgttatggatgtggaggttaagaaaaacagcaaaaacgcgcagctcaaggaccatgaagtcaaagaattaatcaaaaagagccaagagggcgaccagcaggcaagagacctcctcatagaaaaaaacatgcgtcttgtgtggtccgtcgttcaaaggtttttaaacagaggctatgagccggacgatctgtttcagatcggctgtatcggattattaaaatccgttgataaattcgatttgtcctatgatgtccgtttttcaacttatgccgtgccgatgattatcggagaaatccagcgcttcatccgtgatgacggaaccgtcaaagtatcaagatctttaaaagagctcggcaataaaatacgccgggcgaaagatgaactgtcaaaaacatacggaagagtgccgaccgtccaggaaatcgcggatcatttagaaattgatgcggaggatgtggtgcttgcgcaggaagcggtgcgggcgccttcatccattcatgagaccgtgtatgaaaatgacggagacccgatcaccctgcttgatcagatcgccgatcattcagaagagaagtggtttgacaaaatcgccctcaaggaagcgatcagtgatttggaagaacgggaaaaactcattgtctatctgagatattataaagatcagacacagtcggaagtagccgaacggctcgggatttcccaagtccaggtatcgaggctggagaaaaaaatattaaagcagattaaagtgcagatggatcatacggaaagctgaccttttacgggccggctttttttatttgtgcatcggtggtaatttatggtcttttgcggctgatgaatgagaacaaaagtgaaccacatactacatatataaccacccgaaagatggtgatgcaagatggaaagacgaatatttctcagacttcgccaccgcgtgaaggctcataccggagatatcatcacagtcggcgacgccgcgcagattgcgggacagcaaaagctgaaaaaaaaactgtcggcactgccgctgtataaggtcacgaaaaaagacaaaaatatcgtcgtgctggacatcataaaagtgctgaaaaccattcataccgcttttcccgcgcttgatgtacaggccgtcggcggcgctgaaacgatagtggaaatccattaccagaaaaagcagctgtcagccgttttattcgtcggtgtctggctcctgctttttatcggttcatgtcttgccattatgaattttcatgaagatgtcagtatgagagaagttcatatcgccttatatgaaatcataacgggcgaacggaatgaatacccgtatctgcttcagattccatacagcatcggcctcggtctcggtatgatcgtcttttttaatcacatcttcaaaaaacgcctgaatgaagagccaagcccgctggaagtcgagatgtttaattatcagcttgatctcgatcattatgtcgcaatgcacgaaaatgaagagacgatgaaagatctgcatgatcgttagcattcttttcgttgtatttgtcgggcttggcggagggctgaccgtgggcgcgggctttgtggcttttttaaccgttatgggaatcgtcccccgccttatgcagctgacaaaaacaatgcgctttgtacaggcctacgaaggagcagttatttcaggagctgtgttcggcggctgggaaaccttaaatatgaatcatttttttttatctgaatggctggccgttccggtcgggcttttggccggcatgtttatcggcatgctggccgccgcgcttacagaagtgctgaatgtgcttcccattcttgccaaacggatcggcttcggcagcaaaatcattatattgctgatggccattgtgttcggcaaaatagccggctctttatttcattggctgtattttatccatcattcataaggaggaaccgacgtgacaaacttaaaagaaaattacaaaacaaaagtgaaagactatcagccgaaaccgccatatgtttggaattgcgtcaaagcctttctgatcggcggtttgatctgtctgatcggacaggctcttcaagacttttacatccacttttttaattttaatgaaaaaacagcgggcaacccgacggccgccactcttattttaatttccgcccttttgaccggattcggcatttatgacagactcgggcagtttgccggagcgggttcagccgtgccggtgacgggttttgcaaacagtatgacaagcgcggctctggaacacagaagtgaaggactcgtgctcggagtagcgacaaacatgtttaaattggcgggaaacgtcattgtattcggcgtcgtggcagcctatatcgtaggcctgatacggtttgcttgtgaaaaactgttttcgtaggaggagaaaaaatgaaattaaccggaaagcaaacctgggtgtttgaaaacccgttatttgtaaatgcggcggggacggcagccggaccgaaagaaaaagacggcccgctcggttcgctgtttgataagacatacgatgaaatgcattgcaatcagaaaaactgggaaatggcggaacgtcagttaatggaagatgccatcaactcagctttgcaaaaacagaatttgaaaaagagcgatattgatttgttactcgcgggggatcttttaaatcaaaatgtgaccgccaactacgtcgccagacatctgaaaattccgttcctctgtctgttcggcgcctgttcgacatcaatggaaacgattgccgtcgcatccgcgctcattgacggcggttttgcgaaccgggcgatcgcagccacgagcagccataacgcgacggcagaacggcaattccgcaatccgacggagtatggcgggcaaaaaccggataccgccacttcaacggtcacggggggcggggcggtcatcatcagccaaaacccttctgatatcaagattacaagcgcaacagtgggaaaagtaagcgacctcgggattacggacccgttcgatatgggatccgccatggcgcccgctgccgccgacacaatcaaacagcacctgcaggacttaaaccgcacggcggatgattatgatctgattttaacgggagacctttcaggcgtcggctcgccgatcgtgaaagatttgctcaaagaagaaggctatcccgccggaacgaaacacgatgactgcggtcttctcatctatacgccggaccagcaggtgtttgcgggcggaagcggctgcgcctgctccgcgcttgttacgtacacacatatttttaatcaattaaaatcaggggctctgaacagggtgctcgttgtcgcgacaggagcgcttttaagtccgacaatgatccagcagaaagaaaccattccgaccatcgcgcacggtgtggtatttgagcgggcgggaggtgcatcataaatggaatatctgttggcttttgtttgcgggggaatcatatgcattatcggtcagctgctgcttgacatttttaaactgacacccgcccatgtgatgacaacttttgtcgtcatcggcgccttgttggatgggttcggaatatatgacaaatttatcgaatttgcaggtgcgggcgcgacggttcccattgtcagcttcggtcacagcttattgcacggcgccatgcatcaagctcacgagcatggatttatcgggatcgccatggggatttttgaacttacttccgccggtatatcttcagcgattttattcgcatttcttgtagccattatttttaaaccgaaaggataatgcctgatgacgaaacggaaggtcattcttgtgacagacgggacgtatacgccgccaaaacaattgaatatgccgcggaaaaagcaggcgggcggtgtatttcccaatcaaagggcaatccgtcaaccagaagcggccccgaacttgttcagctgattaaagccgcgccgaatgacccggtgtttgtcatgtttgacgattcaggcctgcaaggggaagggccgggcgaaacggcgctgaaatatgtcgcctcacatcaggacattgaagtgctggggtgattgcggtcgcttctaagacccatcaggctgaatggacgaaagtcgatgtctccattgaccgtgatggagaagtgacggagtatggcgtcgataaaaccggaatgagagaaatggacgagcacagaatgaacggagatacggtgtattgtctggataaattggacgttcctctcattgtgggcatcggcgacataggaaagatggggagaaaagatgacatatccaaaggctcgccgattacgatgaaggcggtcgaattcattttagaaaggagcgaaagtcatgccggaaaaaccggaaaacatgatcaaggtataccgggatcctagaaaaaatgaacaattttttaaagaccgcgtcggtatgggaacgagctatgatgtcggcgtccgcaaagttcgagtattagaccgggaagtccagatttactttgtcaacggattaaccgatactttgtttatcattcatttaatggaacagctcgtcgacgtcaataattatgatgagaatgcggatgaagcgattgacgttgttgaaaacaggcttgtcaatcagcaggtccaaaaagtcaaaacgctcgacgaagcaacagatcaagtgctttccggacttgtggccgttatcgttgaagacgcgggcttcgcctttatcgttgacgtcagaagttaccccggacgcacaccggaagaaccggatacggaaaaggtcgtccgcggggcaagagacggttttatcgaaaatatcgtcattaatacagcattgatcagaagacgaatcagagacgaaaggctccgcgtcaaaattacgaaagtcggcgagcgctctaagaccgatcttgccattgtgtatatagaagacatcgcggacccggaccttgtcagcatcgtcgaaaacgaagtgaatgcgattgacattgacggattgacgatgtctgataaaacagtggaagaattcatcgtcaaacagggctacaacccgtttccgatggtcagatacacggagcggccggatgtggccgccaatcacattttggaagggcacgtcatcatcgtcgttgatacgtcaccgagcgtgatcataacgccgacaacgatttttcaccatgttcagcatgcggaagaatacaggcaggcgccttcagtgggaacatttttaagatggatcaggttcttcggtattatcgcttcaacggttctgcttccgatctggtttctctttgttctcgaaccgtctcttctgcctgaaagattggattttatcggtttaaataaaaatacgcacatcccgatcattctgcaaatctttttagccgatttggggattgagtttctcaggatggccgcgatccatacgccgaccgctttatccaccgccatgggtctgattgcggcggtgctgatcggtcaaatcgccatagcggtggggctgttttcagcagaagtgattctgtatgtatcgatcgccgccatcggatcatttaccacgccgagttatgagctcagcctcgccaataaaatgatacgcctcatcttaatggtgctcgtggccattttccaagtgaaaggctttgtgataggctttacattgctgctgatcataatggcgaatatccgttcgtttcatacgccgtatttatggccgtttttaccgtttaacggcaaggcgctgtggcaggtgctcgtccggacgacagtgccgggagcgaaagtcagaccgagcattgttcacccgaaagaccgtcaaagacagccaagcggttcataatcgcattgaaaccgacagaagattatgatattgtatgtcttaacttatacgggacttgtataaggacagctcaaaagaagctgtccttttcacccataggcggatcagaaagagggaatgagcattgttcttacatggcacaagcagacaaaacaaactaggtcatttggaaatcggaggtgtggacgcgctgtatttagcggagcattacggcacgcctctttatgtttacgatgtggctttaatacgtgagcgcgctaaaagctttaaacaggcattcattgacgcggatttaaaggcgcaggtcgcgtacgcgagcaaggcgttttcttccgttgcgatgatacagctcgctgagcaggaggggctctcattggacgttgtatccggcggagagctgtttacggcggttgcggctggttttccggctgacaggattcattttcacggcaacaacaaaagcaaagaagagttgaaaatggcgctcgatcatcaaatcggctgcatcgtcgttgataatttttatgaaatatccttactcgcggaactgtgccgcaaatcagggcgcacaatggatgtgcttctccggatcactccggggtagaggcccatacgcatgattatattacaacggggcaggaagattccaaattcggttttgatctgcataacgggcaaatagaaaaggcgattgaacaagtattgcagtcagaccatatccgccttctcggcgttcactgccacatcggatcgcaaatttttgatacggcgggctttgtgctggccgcagaaaaaatctttgcaaaactgaatgaatggagagaatcattcggctttgtctctgaagtgctgaatttagggggcggcttcggcatccgctacacggaagaggatgaaccccttcatcccgccgtttatgtggaaaaaattatcgaagcggtaaaagaaaacgcagcgctgcacgcttttgacattccggagatctggattgaaccgggacgctcgctcgtcggagatgccggaacgacgctttataccatcggttcgcaaaaagaagtgcccggcacccgtaaatatgcagcggttgacgggggcatgagcgataatatccgtcctgcgctttatcaggcgaaatatgaagccgtatcggcaaacagaatcggagaacaccacgacaaaacggtatccatcgcgggtaagtgctgtgaaagcggggatatgctcatttgggatatagaccttccggaagtgaaagaaggcgatcttctcgccgttttctgcacgggagcgtacggatacagcatggctaacaactacaaccgtattccgcgtcccgccgtcgtttttgtggaagacggcgaagcgcatcttgtcattagaagagaaacttatgaagacattgtaaaactggatctgccgtttaagactggggtcaaacaataaataaaaaagagaccggaacaatggcgtccggtctctttttgcgttcagctgtcagaacttgatccgctgtctcctgtaaatacagacacgatcgcattccaaatcgaagcgaagaaatcaataactttttgaacaaagcttttgccttcatcggattgaatgaacttcgtgattttgtcttttgccttatcgagctggctgccgacttggccccaatcaatctttgcatttttcattttattaaacaatgaaacgagctggtctttttgagcgtcagtcagtgtaatgttaaggtttgaagccgcatcatcgacctttttctcgattccttcttttgtatcgggcacaccgtttttcgcgaaatcatctttaatgtttgcgataagcgcggaggcgtttttatccccgattttatccccgagatttgaagtggtgacaagctcttggttggcgacctgttttacatcttctgaaatcgctttgtctgatgagacttcatatgccttgatgattcccgttaatgctgcggtgcctgatacctcaaacggcgccgtcacgtatactttcgcatctttcactcctgctgtcatcagggcgtttaagtacatttcatccgtaatggaatcgatattatgggtcttaacgtcaagcccggaccctttctttgccaccgtaatggatgacgaagagatggctcttgtgccgatttgggcattcgatatatattttcccagatattcatgttcttctttatttgtgaccgtcacttttgtcgcgttatcagggacatttaattcgtcaagcactttctgacggttttcgtttgacagatccgcccccagtgtgacgatgacatctccgactgcggcatcggccaggctgattttcggtattgtgcacaatacaacggccgccgccagcaatccaatccacatttttttcaaagcggttaacctccttcttttcacaaatgccgttttgaagcggtttgtgaggacctgcgagaagcagttccgatacatagacggctgtgaagctgttctggtttcattttctttctgcggaagcggggagattcgttttccggctgaaggtgtggtataatagccgcgaaaagaagagcagaggcctcttccttcaaaagaatatcaaaaagaaagccggcttacaattgaaattcatattaaagaaggctttgacaaaaaacaatacggaagtaggaatgagaatgaaaactggttacatcgaaatggaaaacggcagcagaatcgaatttgaactttatccgaatgaagcgcctaatacagtcgctaactttgaaaatctggcgaatacgggcttttatgacggcgttattttccaccgcgtgattccgggctttgtcagccaaggcggagatccgactgggacaggcatgggcggaagcggaaaaacgatcaaatgtgaaacagaaggcaatccgcataaacacgaagccggttctttatcaatggcgcatgccggtaaagacacgggttcaagccaattcttcatcgtacatgagccgcagccgcatttaaacggcgttcatactgtattcggaaaagtgacaagcggtttagagcatgcgaaaaacatgtctaacggagacaaaatgaaagaaatccgtgtagaaggataatgacggaaaacccgcctttttcaggcgggttttttttatgtatatgaaaattctcatgtgtaaatcatgaaaaaatacatatatgaacatcggtgatcattctggtatagtgaaaaagaccgattacaacaatgaaaagaggtagaaacgttggttcaattggcaaccgttttatttgtcattatcattctcgcacttatgatttggttcagggtaaaaaagggaaacaggccgattaaaggcggcggcttaggcatcattctcccgcttttgattatcgccgtcatttttacattcagtatcagccagctcatgaatatcccgggaaagccgtttcattttcccgctctttgggagctcgccatcgccggactgttaggcgcggtattcggtatcatcatgctgtcgcaaaccgcctatgaaatccgggaagacggctttgtctactccaagcggaataaaaactttaaatatgtcattatcgcgattattgcgatccgtatcgcactcagccaatatttcaaaagcattgacgcggctgaattcgccgttttaacgatggagcttgcttttgtgtatttgtgcatttggcggatcggaagcttcgtgaaataccgtaaaatcagcagatccggcttataaaatgaaaaaaagggatggggtgcggggcttatttgccctctgtgcagggattcatggtaaaataaaaatgaccatggctaatgggaggaaatcacttgaaatcagaaaaagaaaaaacttctaaaaaaagcgccgtacttgattgggcgaaagccattatcatcgctgtcgttctggcactgctcatccgaaactttttatttgccccttatctcgttgatggtagatcaatggatccgacgctgcatgaccgcgagagaatctttgtcaatatgacggtcaaatacataagcgacttcaaacgcgaccagatcgtcgtgctgaacggagaaaatgagcactatgtcaaacggattatcggacttcccggcgacacggtgcaaatgaaaaacgatcagctgtatatcaacggcaaaaaagtgtccgaaccgtatttagcggcaaataagcacaaggcgaagcaagacggctatgaccggctgacagaagacttcggcccggtgaaagtgccggacgacaaatatttcgtcatgggtgataaccgcagagaatctatggacagccgcaacggcctcggtctttttacaaaaaaacaaatagcgggcacatcaaaattcgtcttcttcccgtttaacgaaattcgcaagacgaaataaaccgtacaggcagttttcttcatgagaaaactgctttttttatataaatttatctctccaccctcaaaaacagaacataaattcgtatatctatttaatagatagaaagttttacagatacatgaaacatcttccctttatgaaacgttatatgaataactcacgcagggaagaacggttttctattcatgaaaaaaaggaatatgacatagtaatgaatagattgatacgggctggaggtagaaaaatgggaagaattaaaacaaaagcagccattttacttgtactgctgctgttattagcgggcggttatatggtcataaacgatattgaactgaaagacgtgccgactgcaatcggacaaaccctgtcccaggaaaaagaagaatatacagtcaaaacatataaaattacgaaaatcgaaggaactgagtaccacggtacggcagcgaacggcacaaaaattatttttaacggcgacaagctgaagcaggatctctccgatgtgcaaaaaggtgataagattaaagcgtatttcagcaaatcaaaccggattgacggcttattgaaggtcgtcaaagtgaacgaataaataaagacgccttttatgggaaaagggcgctttttatttttctgaataatgaggtgcaaattcattgcgcctgccgcaaaggatgttataatagcggataaggacaaaaaaatattgattgtatccttcggggctgggtgaaaatcccgaccggcggtaataaggcgctttgcgctttacagcccgtgacccgtatgcatctgtatacggtggattcagtgaaaagctgaagccgacagtgaaagtctggatgggagaaggatgagagaagctatgcaaaaaataaacttactgtatagtcttatttcctatggattaaaactggcaaagccccgaactgtgtaaacattcggggcttttttgacgccaaattgcgtggaagaagggagggataacaatggatgaatattatatgaatacggcaatagaacttgccagacgcggtgaaggacagacacagtccaatcctcttgtcggcgctgtcgtcgtcaaaaacggacagatcgtcggaatgggcgcccatttgcaatacggagaagcgcatgccgaggttcacgcgattaatatggccggcagacacgcaaaaggcgccgatttgtatgtgacgctggagccttgcagccattacggaaaaacaccgccatgcgccgaactgataataaagtcggggataaaaagggtgttcattgctgtgaaagatccgaatccgcttgtagccggaaaaggcatcggaatgctggaagcagcgggcatcgaagtgaaaaccggccttctcaggcagcaggcagaagagctgaataaaatgtttcttcacttcatgcggaccggacttccgtatgtcaccttgaaagcggccgcgagccttgacgggaaaacagcgaccgaaaccggtgacagcaaatggattacatcagaggcggcaaggcttgatgcccagcaatacaggaaatcgcatcaaagcattcttgtcggagcaggcacagtcaaagccgataatccgagcctgacctgcaggcttcctgatgcggtgaagcagccggtcagagtgattctcgatacaaagctgaccattcctgaaacggcaaatgtgctcactgacggcgctgcgccgacatggatatttacggccaaaggtgcagacgtgcaaaagaaagaccggctgaccgcactcggaataaaagtttttccgctggaaacagaccgcattcacatccctgaggtgctcagtgttctcgctgaaaacggaataatgtccgtttatgtggaaggcggagcatccgtacacggaagttttgtgaaggaaggctgtttccaagagcttcatttctatttcgcccctaaattaatcggaggaacgcttgctcccagcttgatctccggtgaaggttttcaatcaatgaaagatgtcccccatttgcaattcacacaaatcacccaaatcgggccggatataaaactgacggccatacctaaagatggaaaggatggtgacgatgtttacaggaatcgttgaagaaacaggcacgatccaagcaatcgaaaagacaggcctttccatggcattaaccatcgccgcttcaaaagtgacaagtgatgtgaaacttggcgacagcattgcggtaaacggcatctgcctgaccgtaaccggattttctgacaatcaatttacggttgatgtcatgccggaaacagtgaaatccacttcgctgaacggcttgtcaaaaggcagtaaagtaaacctggaaagagcgatgtccgccaacggacggttcggcggccactttgtatcagggcatgtggacggaacggcggaaattacgcggatcgagaaaaaaagcaacgcggtctattacgatttaaaactttcgccggaattgacaaaaacgctcgtattgaaaggttcaattacggtagacggcgtgagcctgacgattttcggtctatcagatgaaagcgtgacggtatccatcattccgcataccatctcagaaacgatttttcagacgaaaacagtcggatcgaccgtaaatattgagtgtgacatgatcggcaaatacttataccgctttttgcacaaaacagaacaaacgaaaagcaatcaaactatcacggaagcctttttaagcgagaacggcttttagaaaggaagatcgatatgtttcatccgatagaagaggcgttagaggcgctgaaaaaaggtgaagtcatcattgttgtcgatgatgaagacagagaaaacgaaggagatttcgtagcgctggctgagcatgccacgcctgaagtggtgaattttatggcgacccatgggagaggtctgatctgcacgccgctgtctgaagacatcgccggccggctggatcttcacccgatggtcgatcataatacggactcacatgagaccgcctttacggtcagtattgaccacaggctgacaaaaacgggcatcagcgctcaagaacgttcttttaccattcaggcgctgttgaacgaggaatctgtgtctgacgattttcagcgtccgggccacattttccccttaatcgcaaaaaaaggaggcgtcctgaagcgggcgggccatacggaagcagccgttgaccttgcaaaagcctgcggatctcagggagcgggcgtcatttgtgaaattatgaatgaagacggcacaatggccagagtgccggagttagccgaaatcgccgaacgtcaccagctgaaaatgattacgataaaagacttaatagagtaccgttacaacattacgacacttgtgaacagagaagttgatattacgctgccgactgacttcggcacgtttagagtttacggatatacaaacgaggttgacggaaaagaacatctcgcctttgtcatgggggatgtcccgtttaacagcgaacccgttcttgtcagagtgcactcagaatgcctgacgggcgatgtgtttgcatcccatcgctgtgattgcggacctcagcttcatgccgcgcttgcgcaaattgctgaagaaggccgcggcgttctattgtatttgcgccaggaaggcagaggaatcggtttaatcaataagctgaaggcgtaccgattgcaggaacaagggtacgacacggttgaagcgaacgaagcgctcggctttctgcctgatctgcgcaactacggcatcggcgcccagattctccgcgacttaggggttcagcatatgaaacttttaaccaataacccccggaaaatcgccggcctcgaaggatacggtctcagcatttcggaacgggtgccgcttcaaatggaagcgagtgagcataacaagcagtatttacagaccaaaatgaaaaaacttggacatctgcttcatttctaaaaacaaatctcacaaaaaaggatggataacatatgaatatcatacaaggaaacctagtaggaacaggacttaaaatcggaatcgtcgtcggcagatttaatgaatttataacgagcaagctgttaagcggagcggaagacacgctgcttcgccacggtgtagaatcaaacgacattgacgtcgcttgggtgccgggagcgtttgaaatcccgtttgcggcaaagaaaatggcggaaacgaaaaaatacgatgccgtcattacgctcggcacggttatcagaggagcgacaacgcattatgactatgtctgcaatgaagcggcaaaaggcatcgcccaggcgggaacggcgacgggcgtcccggttatcttcggcatcgtgacgactgaaaccattgagcaggccatcgaacgagccggaacaaaagccggaaataagggagcggattgcgcagtatctgccattgaaatggcaaatttaaaccgttcatttgaataatttgttgaaaagcgtttaaaaccgcggcgaaaatgatataatgtgagaaaacggatcgcctttatgtatccgtttgataggacatgaatggacattttggatatagaggggtttttatgttaattcgttataaaaaatcgtttgaaaagattgcgatgggtcttctgtcatttatgccgaatgaaaaagatctcaagcagcttcagcagacaataaaggactatgaaacggatactggccgccagctctttctttggaaagaggatgaagatatcgtcggagcgatcggagtcgaaaaaaaggactcagaggttgaaatccggcatatcagcgtgaatccttctcaccgccatcaaggaatcggaaagcaaatgatggacgccttaaaacgtctgttcaaaacggaggcactcgttccgaatgaattaacgcaaagcttttttgaacgctgtcaacatcaaaaagatcaggatatctcatataataactgacaaatgctcccggaatcttcacggtttcgggagctgttttgatatagaaaaagcagggctgaccgtcagcctctgcttttttttcttctctcaatttcccgttcgcgttccttaatgacatccgtcctgtcccgcaggcggtgtttatgaataagaaaggtatctgatacgccgtcttgcccccatgtatagccctttcggcggcattcggcaagacatgcttctttcagggcttcatctgtaatcggaagcataacacttctgtaaggcaggcccgcttctatatcgtctgacagcgtttctatcagctcaatcagcttcggatggctgagaccgagagaacagaccgcctgcttttcagaccggagaatacgtaagctgttggcaatcagccgtttcgccccggcttcatttcccctgcgctggtgatacagagcgacggcaagctgaatcaggccgacccaatgaatgctccgcttttcagccgggctttctttccaatattcctctaacagttcatgacattcaaaataatctcttgatgcgtgaaattcggccaaaaagccgatataagctttaggatacaagccgcttcctccttttatgctaaaaccagtgtaccacagcgctttgaaaaggaaaaaagagcggcttggtgtctgaagcctgaggaactagcagatgtaagatgctcctacgacaacgagcaaaataaacagaacgacaattaatgcaaaacctccgccgaaacaagctccgctcatgtgaaatcagcctccctttgtttcaagtttacacggctatcctatgtgcatccgcctttaaaggtataggcgtatatcttctttttcagtattttctaaataacggaggacgtgtataaaagtattggacgagagcatttcggtggattatactaaagggtagccagtttttccggcaatgagagtgatactgaaaatggtgagataatggtagaatatcaagtgaaaattgatacgtttgaaggcccattggacctgctgcttcatctgattaaccgtcttgaaatcgacatatatgacatacccgtggcaaccattactgaacaatatttattatatgtacatacaatgcaagagcttgaacttgatgtcgccagtgaatatctggtcatggcggcgacgcttctcagcattaaaagcagaatgctgcttccgaaacaagaagaagagctgtttgaagacgaaatgcttgaagaagaagaccctcgggacgagctgattgaaaagctgattgagtatagaaagtataaaaccgctgcgaaggatttaaaagagcgggaagaagaaagacaaaagtcatttacaaagccgccgagtgatttaagtgagtatgcaaaagaaatcaaacagaccgagcagaaactgtcggtgaccgtttatgacatgatcggcgcgtttcaaaaggtgcttcagcgtaaaaaaatcacgcggccgaaagaaacgaccattacaagacaggaaataccgattgaagacagaatgaaagaaatcgtaaaaagcttaaaaacggcggggagaagaataaacttcacggagctttttccttctcggcaaagggaccatctcgtcgtgacgtttttagcagtcctggaactgatgaaaaatcagcagattatcattgaacaggaagaaaacttttcagatatatacattacggggagtgaatccattcatggcgtttgatatcgtgaattggaaagcgattgtggaagccctgctgtatgcggcgggtgatgaaggactgaccaaaaagcaattggtgacggtgcttgaaatagaagaagcggaactggccggaatcatggaagaagtggccgctcagtacaaggaagacgacagaggcatcgagcttaccgaatatgcggatacgtatatgcttggaacgaaaaaagaattcgtgccttatttgaaaaaactaatcgaagtgccgtcaaaagggctgtcgcaggcttctttggaagtgctggcgatcgtttcgtacaagcagccgatcacacgggcggaaattgaagatatccggggcgtgaagtctgagcggattctgcacagcctcgtgtcaaaagcgctgctgtgtgaggtgggccgcgccgacggtcccggccgggcgattttatacggcacgacaccggtatttcttgaacaattcggcttaaaaacattggaggagctcccgccgcttcctgaaaatgcggaggaagacgttctccaggaggaagccgatttattctttgaaaacttcaaccaaacttttgaggatattaaataataatcgtttttcatcatacgatagtagggaaaggccattgatgaatgacgcaaatgacgacgtacaagagaggaaggaaacggacggaaatgggaaattcgattgtgagggcccatactgaagaaactggtgaatttttagccgaggttgtcacgatggtcagcagctatttaaatcatacaacattgccggagatgcgggctcaaggagaggcggatgaggcatactgccgcgacgtgctcagtgtgctgaggaggatgaccgtcttttgcgaaggcgcccaggaagcctgccggcggctcttaatgcaggagccgtttcatgaggtgagagcggaaaaaacgctgtataaagtgtatcatcagtgcgtggaagaatttttcatgccaaaaaaggatacatggtacgaaaacagccgcgccgcttatacaggccaaagcgcgattgagttctaccagcaagtgccggactcgctgcggagccttctgctttcgctcagcagtgaatttctgcggatgcgggaagaattggcgcaatatgaagcatcaggctcaaatatggcatcagtcagataaaaactcttccttttgggagagtttttttatgtgaaagtgatgcaattggtattcataagtcatggacaggcgcataaacttgtacaaacccacaacaaggacgtgagcattcatgcgctttctcaaaaaagctgccgtatttcttttgacttttgttattcttttttccattacagacggcaatacggcacatgcccaaatacatgtcagcgcaaaaagcgcgattattatcgacggagcatctggcagggtgttattcgccaaggatgaacatcataagcggcggattgcaagcattacgaaaatcatgacggcggtgctggcgattgaatcaggaaagatggaagagaccgtgacggtttccccgaatgctgtaaaaacggaaggctcagccatttatcttcagccgggacaaaaagtaaagctgaaagatcttgtatacgggcttatgctgagatcaggaaatgacgccgctgcggcaatagctgaatatgtcggcggaagccttgacggttttgtatttatgatgaacaaaaaagccgagcaaatcgggatggaaaatacaaaatttcaaaatccgcacggactggacgaccatgaaaatttatattcaacggcgtatgacatggcgcttttgactaaatacgcaatgaaaatcaaggaataccggaccgtttcaggcacaaaagtgtataaggcggaaacgatggaccgggtatggaaaaataaaaacaagcttctgactgggctctaccgttacagcacaggcggaaaaacgggttacacaaaaatcgcgaaacggacgctcgtttcgacggcttcaaaagacggaacggatctcatcgcggtcaccataaatgatccggatgactgggatgaccatatgaatatgtttaattatgtctttgaacactataaaacctatgtcgtcgctaaaaaaggcggcattccgaagctgaaaaagacgttttacggaaaacacgcttttattgcccgggatgtcaaatatttattaaaagaggatgaaatcgacgatgtaaaaatccgcacaaccttaataaaaccgaaaaaagcctggaaaaaggacgcctctctcattcctgatgtcgtcggccggatgactgttatgcatgatgggaaagtgatcgccaagattcccgtctattatgaaaacgagcgccataaaaaaccgaaaaagcatttcattgagacgtttacgagcctgtttatgagcgcggcgggcggttcgtcatggtcaatttaatctgggtatgtctgacggtaatcggacttgtctttgcgatgtttaacggtaccttgcaggatgtgaatgaagctgtttttaaaggagcaaaagaagcggttacgatctcgttcggattaatgagcgtgctcgtcttctggctcggcctgatgaaaatagccgagcagtccggccttttggatatattcagcagaatgtgccgcccgtttatctctaagctgtttcccgatattccccctgatcatccggccatggggtacatcttatcaaatctcatggcaaactttttcggactgggaaatgcggcgacaccgctcggcattaaagccatggagcagatgaaaaagctgaatggaggtaagtctgaggccagccgttccatgattacctttttggcggtaaatacttcgagtattacattgataccgacaaccgtcattgccgtgcgcatggcttattcggcgaaatcaccgaccgatatcgtcgggccgaccatcttagcgactttaatttcgggaatcggcgcgattttcattgaccgctacttctggtaccgccgcaaaagaaaagggaggtaagcgaatggaaatggtgaattggctgtctttagccatgattccgattattatcgccggtatattgatatacggcacgatcaaaaaagtgccgacgtatgaatcattcgttgaaggcggaaaagaaggaattgagattgcgttttccatcattccgtatttggtcgggatgctggtggcgattaccgtattccgggcctcaggcgcgctggattttgtcatggggctgtgcaagcctttctttacagcgctcggcattcccgcagaagtcgtgccgcttgctctgatccgcccgatttcggggacggcggcgctcggcatgacgacagatctgatcgccgtgtacgggcctgattcatttatcggcagactggcctcggtcatgcagggatcgactgatacgacgctgtatgtcctgacggtgtatttcggggcggtcggcatcaaaaaaatgggggatgctttaaaggtcggtcttcttgctgatctgatcggggtggttgcatcaatcatcatagttgcgttattatttggaagcgcctgaaatcaggcgctttttatatatcagaataactctccttgaaaaagcttgtttgttcaaggggaaaaaagtaagattatacttgaggtgaacgacatggaaagactgcaaaaagttattgctcatgccggcgtggcatcacgcagaaaggcggaagagctgataaaagaaggaaaagtaaaggtgaatggaaaagtaataacagagctcggcgtaaaagtgaccggttctgatcagattgaagtaaacggattaaaggtggagcgggaagaacccgtgtactttctgctttataaaccgagaggagtgatctcagcagctgatgacgacaaagggcggaaagtggtgaccgactttttcaaagaagtgccgcagcgcatttatccgatcggcaggcttgattatgatacgagcggacttttattgctgacaaatgacggcgagtttgccaacaaactcatgcatccgaaatacgaaattgataagacgtacgtcgccaaagtgaaggggattccttccaaggaacttctgagaaagcttgagcgcggcattcagcttgaagaaggcaagacggcgccggccagagcgaaaatgctttccctggacaaaagaaagcagacgagcattattcagctgacgattcatgaaggccgaaacagacaggtccgccgcatgtttgaggcgatcggtcatgacgtgctgaaactcaaacgtgaagaatacgcatttttagatttaagaggcctgcgcacaggagacgcaagagaattgacgccgcatgaggtgaaaaggctgcgggctttagctgaacacggtaaaaacgctttctaattttcacataaccttcaaaaattacaaaacgtgtagatgatataattgaatggatttgcagacaggggaggggagcagtgtacaatgaacaaaaaacggcggcgtttattcattcggaccggcatccttctcatcttactctgcgcgctcggatataccatctataatgccgtttacacaaacggagagcgtatatctgaggggtccaaagccccgaatttcgcgctgaaagatacagagggcagactcatagaactgagtcagttaaaagggaaaggtgtttttctgaatttctggggaacgtggtgtgagccgtgcaagcaggaatttccctacatggagaatcaatacaagcattttaaagacctcggtgtcgaggtggttgcggtaaatgtcggcgaatcaaaaattgcagtacataattttatgaaaacatacggcgtcaatttcccggttgcgctcgatactgaccggcaagtgctggacgcgtacggcgtatcacctattccgacgacatttttgatcaatcccgacggaaaggtcgtgaaagtggtgaccggcacgatgacagaacgcatggttcatgactatatgaatttaattaagccggaggcgtcttcatgaaaaaggtcaaatgtgagtgcgggcacgtgaatccagccgggacggttttgtgcgagtcgtgcgggaagccgcttgatgatcaaaaatcgccgcttgccgatatgcggtacgacggcagcgcaaggcgttcgcaaacatataacaaaacaatcgtagataaggtatggaacttcttttcttccgtaaaagtcggaatatggctgatcgtcattactctggcggcgtctgctttcggcacggtttttccgcaggaagcttatctgcctccgggcgcccagccggatacatattatgaacagcagtacggcataatcggccaactgtattatttgctggggtttcatcacctgtacggctcatggtggtatatgctcctgatcgcatccattggcatatcactggtcatctgcagcctggatcgggtgattcctttgtacagggcgcttaaaaatcaaggagttcggcggaatccggtctttttgaagaggcagcgtctatacagccggacagaaaccgagctgagcggggatgcggctgatagcctcagaacacgattgaaaaaaaagcattatagagtgcgagaacaagagggaagcatcctggcggaaaaaggccgtttttcaaggtggggaccctatgtcaatcatatcggcctgatcatttttctgatcggagccatgctgagatttgtacccggtatgtatgtcgatgaaacgctctgggtccgtgaaggcgaaaccgcccagatccccggtacagacggcaaatattacttaaaaaacaaccggttcacgatgcagacatataacaaagacactgagaaaaaagtattcgccgacgccattgacagagccggaaacggcaaagtcgccaaatccttcacaacggacgcggttctgtacaagagggaaggcgacattgtattcggtgaaaagccgaagcttaaaagagtcaaagaaaacaatatccgcgtcaatgaaccgctgcgctttgactcctattctgtgtatcaggtggactataaagaaaaccagctcgatcagatggtatttcagctgatcgaccaaaaaacaaaacagtcattcggcaaactgaagatcaatcttcttgatcccgacacggactacgatcttggtaacggttacaaagtgcagattgccagttatcttcctgatttttattttaacaaagacggagaaccgagcacgaagacgaaggttcctaacaatccggcttttgtctttaaaatcacggctcccgacaagccgaaaggggagaaaagttttgttgcgattcagcagactgttgaaggttccgaaagtaacaagtacaaattaaaattcgaccatgtggaaacgaaaaacattacaggactcaccgtcagaaaagacttaaccttatgggtgcttgccgtcggcggcgcgatctttatgatcggcgtcattcaagggatgtactggcagcacagaaggatctggatcaaaacaggtgatcatgaagtgcttgtggcgggacatacgaacaaaaactggttcggtctgaaaaaggatatcgaatttgttcttagcgggaccgggattcaagagccggccgatcaaaaagaattggccaaaaatcaggcctagtgaaaaaggagtggtgtcatggcggagctgagcgcaaattttctttatgctgcctttttgatttatttaattgccgtcccggttttcggcggcgccatccggggaacaaaaggtgcgaaggacggtaagggccgctggtcggctatcggaatcacgttaaccattttcggatttctttgtcacctcggctactttattgcgagatggtcggcaagcggacatgcgcctgtcagcaatatgtttgaatttacgacgtcattcggcatgatgcttgttctcgcttttattattatttactttatttacagactgccttcattaggcatgttcacattgtctatcgcgcttttgcttatcgcatatgcaagcatgtttccgacagacatcacgccgcttattccgtcactgcagagcaattggctgtacattcacgtcacgactgcggcgctcgggcaggcgattcttgcgatcagttttgtagccggcgtcattttcctgttaaagcatgtcgaccaatccagaccgggcaaaaaaacgttctggcttgaagtcatcatgtttatactcgtgacgaccgtggcatttatcgccgtcacgtcggcattccggctggcggactacaaagcagaatttaattgggtggataaaaaagaggctaaaagcgtgatgatatatgatatgcctgcgcttgtcggcccgcatgacggagaactgcttacggaaggcgcaatgaagccgcttattgagcttccggccattttttcaggcagaaaggtcaatacggtgatctggtcgtttggcgcaggtctcgttttattcggggcgctcaggctgatattcagaaagagaatcagcgctcttataagcccgctcgtcaaaaatgtgaatctggacttggtcgatgaagtcggctaccgcgctgtttccatcggttttccggtattcacactcggcgcgcttgtgtttgcgatgatttgggcgcagcttgcatggacgcgtttttggggctgggacccgaaggaagtatgggcgctgatcacctttttattttacgcagcgtatttgcacttgcggctgtcaagaggctggcatggcgaaaagtccgcgtggcttgccgtcatcggcttcgccattattatgtttaacttaatttttgtgaatctcgtgcttgccggacttcattcgtacgcatagatgcaaaaagccgatacagttctcaagctgccgcacagtttgttaaaatgaaagtaacagaaggaaagcagggggaaaacgatggatcaaacaaatgaaactaaaatattagtagtagatgatgaagccagaattcgacgccttttaagaatgtaccttgaacgggaaaactatgtgattgaagaagcggaaaacggagacgaggccattaaaatggggctggcatcagattatgatctggtgctcttggatttaatgatgccgggaacggacggaatagaagtatgccggcagctcagagaaaaaaaagcgaccccgattatcatgctgacggcaaaaggggaagaagccaaccgcgtccaagggtttgaagcgggtacggacgattatatcgtcaagcctttcagcccgagagaagtggtgcttcgggtaaaggcgcttttaagaagggcttcccaaacatcttatctgacagccaataccccgacaaaaaatgtactcgtcttctcgcatctatccattgatcatgatgctcacagggtgactgcggacggcacggaggtgagcctgacgccgaaggaatatgaactgctgtacttcctggcgaaaacaccggacaaagtgtacgacagggaaaagcttttaaaagaagtgtggcagtatgaatttttcggagacctcagaacggtggacactcatgtcaaacggctccgtgaaaaattaaacaaagtgtctccgggagcggcgaaaaaaatcgtcaccgtctggggagtcggatacaaatttgaggtaggcgctgaatgaagttttggaaaagcgtagtaggaaagctttggtttaccattctttcactcgtgttaattgttttatttattttaacggtgctgcttctggaatttatagaaaattaccacgttgaagaagcggaaaaagatttaacgcagcttgccgataaaattgcggtcataatagaaaatcatgaagaccagccgcttgccagatccatcacgtgggaactggcggacaatttaacgagcatcgcgatcattcaggatgataagcatgtctggtattcgcccaatgacgataatcatttatcctctattacattagagcagattaaacatgaccgggatctgcacaaggcgctgacagaccgcaataaagtaagcaaacgcgcggtccccaaaaatgccggttcggataatgaacggctgatcgtcggagtgccctatgaaaaagacggcaaaaaaggcatggtctttttatcccaatcgctgcttgccgtcaaagatacgacgaaacatacgacacgctatatttttcttgcggcgggcattgccatcgtcttgacaacgtttttcgcattctttttatccagcagggtgacatatccccttcggaaaatgcgggaaggcgcccaagacttggcgaaaggaaagtttgatacaaaaattccgattctgacccaagatgaaatcggggaactggccattgcctttaatcagatgggacggcagctcaatttccatattaacgcgctgaatcaggaaaaagaacagctgtccaatattttaagcagtatggcagacggggtcatcaccattaatatcgacggcaccattttggtgaccaacccgccggccgaacgttttctgcaggcatggtattatgagcagaacatgaacattaaagaaggagacaaccttccccctgaagcaaaagagctgtttcaaaatgcagtgaacacggaaaaagagcaaatgattgaaatgacgcttcaaggaaggtcatgggttttattgatgtcgcctctttatgcggaatcacacgtccgcggcgccgtggccgtgctccgtgatatgaccgaagagcgcaggctggataaattgcgtgaagacttcattgccaatgtcagtcatgagctcagaaccccgatttctatgctgcaaggatacagtgaagcgatagtggacgacattgcaagcaccgaagaggagaaaaaagaaatcgcgcagatcatttatgatgaatctcttcgtatgggccggctcgtcaatgatttactggatttggccagaatggaatccggacatacgggtctgcgctatgaaacggtaaacctgcatgaatttctggagaagatctcccgcaaattttccggtgtagcgaaggaaaaaggcgtttcgctcacagaggacatctcggtgtctcagccggagtgtgtctttgacgaagacaaaatggaacaggtgtttaccaaccttatagataatgcgctgcgccatacggagtcaggcggaaacgttcatatcgcggctcataccgtaaaagacggactgaaaatcgatatcaaagattccggctcgggaataccggaagaggacctgccttttatttttgaacgtttttataaagcggacaaagcaagaacaagaggcagggcagggaccggactcggactcgccatcgtaaaaaatatcgtggaagcccacggcggctcaattgcggttcacagcagcatcgacaaagggacgacgtttacattttatattccgacaaaagcgcaggatgacgtctgaaattgacgaacaatcttgttccatacgaaacacccgcagaacatgcgggtgttttttgtttttttctcctttaaaaatttaagaatatgttaatataaattcccttccaaattccagtttctcgtaatatagttgtaatgtaacttttcaacgcatttttacgacaaaaaagtgaacggaggggtttcccatggaagaaacctttcagatattatacgatgcataccatcaagatttatatcaatttttattttatatggtaaaagataagtcgcaggctgaagatttgacgcaggaagtgtatatccgcgtcttgaattcctatcatacatttgaaggaagaagcagtgaaaaaacatggctgttgtccatcgcacgccatgtggcgattgactggttccgcaagcagcagacgatcagacagcgtattatgggtacgtttgattgggatacacaagatgtcagagatcagcatttgcttccggacgaactcgccgtacagcatgaaaatgtccgggaaatttataccgcgcttgatcattgcaccattgatcaaagagctgttattatcttgagatttattcagggatattccattcaggaaacagccgccgctctccgcttctcggaaagcaaagtcaaaacgacccaacacagagggctcaaaatacttcggaaacagatggagcttttgagggaggagctaatggatgatgaagtcatattggaacgaagaaagagtagaggagttgttaagacaacttccggcggttagagatcatcgttcacccgaggccatttaccggaatattgaaacgggtaaaccgtacaggaaaaaaccggcccgaagctggatcggccccgctgcagccggcatctgcgcattgtgcatcgctctgattatttctcctcacctgatgacaaacaaatctgccggtgatcttacagctgacagcggtcaagctgaaaaagccagtcagtcagctgctgtcaagccggatcagaagacgtttgtcgtttctaacgaaaacaaaaacaattacattactttggcgtttgccgattcagatacatccgccgtcattccggtcagttttgaaaaaaagaagcctgacgaatcggtttcagaggcattatctgatgcaggaaacttagaagtgcccgaatctttcctctctgtgccgaaccttttggacggtgtgcaggtaacggcggataagaaggatttgcttgtgcaggtaaacggacgtctttctatcgaatcagctgccgattctgatttattgaaaaagatgctgaaagagactttgacatggagtccttacgagcggattaaattgaaaaaggttcaaaacggagacggacaggatttttataaatcttacggcatttccgctgagatgtccgtacataaacagacaaaccgggcgtatttttcttacagcgacagtctgggacaagagtatctcatcccgtctgaacaaacctattattcagtatatcaggctattgacgggatgaagacaacagacggaggctcacagaccgcgagcattatagaagcagatgcgattgcatcggtatcggaaagggaagacggcgagcagctgcggatccaattgtccgaaaaacataaagttgaagattcgctggaaggcattttaatgatcgaagggcttttgttaaccgcgaaggaattcggttattctgaggtgctgttcacacatgcgcacgcaaagaaaatcggtaattatgatgtgacaaaaccgattgctgtgcctgccgcgcctaatccgcttccgacccattaaacgtaaaaaaacccaaaacatatgaatgttttgggttttctgttggttacggaaggtcaatcagtttaacggaaacaatatcctgaaccgaagtcagctcattgacgactttatcatctaaatgtttatcaaaagaaagcatcataatggcttctccgcctttttctttacggcccacctgcatggtagcgatattgatatcgttatcgccgaggatgcgtccgacgcgtccgattacaccagtcgtatcctggtgctggatataaacgaggtggccggcaggatttaagtcaatattaaagccgttcagttcaacgattcgttcaccgaagtgagggatatacgtagccgttaacgtaaatgtgctccggtctccggttacttttacgctgatgcagttatcatatcctgattcattggaggaaatcttctcgctgaagctgataccgcgttcttttgctacaccgcccgcgtttacttcattgaccgttgagtctacacgcggttttaagaaaccggacagcaggctttttgtaataaatgatgtttcaagtttggcgatggtgccttcatattgaatcgcaacatctttgacgggttccttcatacattgtgatacgagacttccgattttatcggcaatttggtgataaggctggatttttttgaattcatctttcgtcatcgcaggcaggttgatcgctgacatgacaggcagaccttttgcaaactgcagcacttcttcagaaacctgtgccgcgacattcagctgtgcttctttcgttgaagcgcctaagtgaggtgtggcgatcaccagcggatggtcgggaagctttgattcaactggcggttccacttcaaacacatcaagggcagcgcctgcgacatggccgctttccagcgcttccaaaagcgccgcttcatcaataatgccgcctcttgcgcagttgataagacggacgccttttttcgttttggcaatggtttctctgttaagcaatccttttgtttcctttgttaaaggcgtgtggacggtaatgatatccgcgctttcaagcacttcttcgaatgtccggctgtttacgccgattttgccggctctctcttcggttaagaaaggatcgaatacatgaactgtcataccgaacgctctggcgcgctgggcaatctcgcttccgatccggcccagaccgacaatgcctaaagtctttccgtagagctccgccccgacaaaagccgtccggttccattctcttgattttactgagatattggcttgcgggatgtgtctcattaatgaagaaatcatcgcgaatgtatgctctgccgttgaaatggtgtttccattcggcgcgtttatcacgataactccatgttttgtggcctcatcaatgtcgatgttgtctacgccgacaccggctctgccgacgatttttaaagaagtcatctttttaaacaattcttcggttacttttgtggcactgcggactaacagggcatcaaaggtatgtaattcatcttctgcatccgcgacgtttttttgaacaatttctataaagtctgattccatcagcggctttaagccgtcattgctcatcttatctgagaccaaaactcgaaacattgttagatttcctcctagtttagctgactaaatatctgataatttatcatattctcaatagagtgtcaatgtgtattgacgcagtaaaggagaaaaggaaaccgctgaatcagctgaaattgggcttccccaatattttatttaaatttgagcagttctctatacaattacaatttgatcatatataatgtgaataaattcataagatcaatcttcggggcagggtgaaattccctaccggcggtgatgagcgtcacgctctaagcccgcgagctgcttcggcggcaggatccggtgagattccggagccgacagtatagtctggatgggagaagatggaggttcagcagacgttttgatgcttatatcaaacgtttctttgccaagccttagtaagctcccgctttttaacaaaagcggtttttttattggggcgcaaaagaacctttcctcttttcgagagatttgatcgaaaaggagagagcattgtgaaagtaaaaaaattagttgtcatcagtatgcttagcagtattgcgtttgtgcttatgctgttaaatttcccgtttccggggctgccggattacttgaaaattgatttcagtgacgttcctgcaattatcgctattttggtttacgggcctgcggcggggattgcggttgaagcgattaaaaatattctgcagtatatcattcaaggaagcatggccggcgtgcctgtcgggcaggcagccaattttatcgcggggacgctgtttattctgccgacggcgtttatgtttaaaaagctcaattctgcaaaagggcttgcagtgagcctgctggccggaaccgcggcgatgaccgtgctgatgagtattttgaactatattcttatcctgcccgcgtatacttggtttttacattcaccggcattgtcaaacagccagttgaaaacggcggttgtcgcaggaattctgccgtttaacattgtaaaaggcattatcatcaccatcgtctttacgttcatctttacgaagctgaaaccttggattgaacaaaaacgcagcatccaaacacaataaaggcttaaagcgtccgctctgtgaagaacagccggacgctttttttgtttgtgctgatcggcaaaaaaataagactccggccgataacagccggagtcttattcaggacgaaaaagctcctctcacggggagggcttttttattcgtatttcagcgggtcgccttcgaacggttcatccgcaactttgattgaatcagtagggcatccttcaaatgcgtcaatcatatcttcttccagaacttccggaacttcgacgacacctttattttcgtcaagcgtaacgaacgcaatgccttcatcatcataatcataaatgtctggtgccgcagctccgcaggcgccgcatgcaatacacgtatctttatctacaattgtgtactttgccatgaataaaacctcccagattgttcgtgttggaacaaatggtttaccttatatatttttaaatataacacctattcctcttacttattgtaatgatgttagtgtcaaatttcaacagaaaaatgattgagaatgcttatcacataagggattctctttagcacttccccctaaaagatgactttaaacgtcaaatttatatgaaaatctgttaaaataaaaagaaccaaaaaacgaaacttgtcacaaaagaaatgtaggtgtgtttagattggcgataaactactttgataccgtggttctcgactgtctggacaaaatagacggcgaacggactccgagtgctgtgtttcatttattaaaaggaaaaaagtcgtctcaaaccattcaggatgccggcttatttcagatcgctaaatatttcggcatggcttcacagtgtgaacgcggcgatattgcggcttctatgcatagactcaccgagaactcatacatcacagccggaaaagaagagggaacgcggaaagtgactgcgcgcggcgttcaaaggcttgaacgggcgtttgctgagcggccttggccgaagcactgccacggcgcaaattatcaaacgcctgccgtcatcctgtggaggcggctttccctgctcattcaagtcctgtcaaacaaagagcatcaatgcagtcaatatatcccggttaccaacgatgtgcagacgctgagatgggtcaaatggttcatgcggaaaaacagagatgctaaagagctttccgtccaaatgcatgacgcgctgtttcagcttctgcaaggcgtaagtgaacggcaggcgcttatttttgtctattctttaacttcattcaacagaatcggcaaaacgaataagcagctcgctctccagctgaacgaagatgaatggtatgtgtccgtccagttttggggagcggtacattatgttattcaatcgcttccgcaatgtgcatatcccgctctgcgcgagctgttgtccgatctgcaggcggaaagcgcgctgacacagtctgccagaaaaacctttgagctgttggaaaaagggtttccgattgaacggatcgccgcggtcagaaatttaaaaaccgccacaatcgaagatcatatcgtagaaatatcattgcatcagcctgcattttttatagaacagtatctttctgaagaggaacagcgtatgataacggcatttgcaaaacagcatcaaacaaataaaattaaacggattcgcgaaggaatgcagatgcgcttcagctatttccagatcaggctggcgctggcaaagacggtgaatcagcatgactgagctgcataaagctttatccagatattttggtttgcattcctttaaaaaagggcaggaagagattatgactagcgtgctccaaaaaaaggatacgatcgccatgcttccgaccggcggggggaaatcattatgctatcagctcccgggttacatgatggacgggctggtgctgattatttcaccgcttctttcattaatggaagatcaggtgcagcagctgaaagcaaaaggagaaaagcgggttgcggcattaaacagcatgctgaattccgcagagcggcattttattctcagcaacatcagccggtataaatttctctatatgtctcctgaagccctttcttcaccttatgtactgaaccgtttgaaaaacgttccggtcagtttatttgttattgatgaggctcattgcatatcggaatggggacatgatttcaggcctgattattcgaagctcgggcctttcagacaggcactcggaaagccgcctgtattggcgctgactgcaacagcgacaaaagaaacgctcagagacgtgacggatgtgctcggacttgagcatgcggtgcgtcatctttattcagtcaaccggccgaatattctcctggcggcagaacatttggctgataatgccgaaaaaataaacaggctcacggagcttgccgaaaagcttgaaggccccggtatcatatattgtccgaccagaaaatgggcggaagagcttgcggctgagctgaatgaaaaaacgggaaagcggacggattattatcacggcggaatggatacaggggacagaatcttgatccagcagcaatttatccataaccagcttgattgcatctgctgtaccaatgcgttcggcatgggtgtggataagtcagatatccgctttgtcattcacttttatcctccccaaacggctgagggctttatgcaggaaatcggcagagcgggacgcgacggcagcccgagtgtcagtattttgctgagggcgcccggcgataccgagcttcagcagcagattattcagacagaaagcctgtctgattatgatctggaaggcattttggccgtcatacgggatgccggtacggatgatgagcgaaagcttcgggacgttctgatcaataaaggcgtccaggaaacacaggcgcgaacggccgtccatctgtatctgcaaggaaaaaccacaaaagagcagctgcaggaagaactgacataccgcgtggaaaagaagctgcgtaaaatgaaccgtttttcggcgttattagagcggaaagaatgtataagaaaagcgctgctgtcttattttgatgaatcgtatgagcctgaaggccaaaccggacaatgctgcagcagctgcggacttgatctggctccgtacgagcaaaaaggagaacggaaaaacatggaacggtttgaagattggaagctggaattaggccggattttcggttcagagtctgcgggtgagttcagctgagacggcaaagcgaattgatccagcagctctcagaccgggagattgtgatacagctgtatgccacccaattgctcatattggcggtttcagctgttatcggctttttctttttcaccgacattcacgattttttaaagctgtggcatatacgtgacgataatatcatatggtacggtgtaactcttgccgtccttgtcatttttgccgatctggcggtgatgaaatggtgtccttcgcatttatatgatgacggcggcattaatgtattgctttttaagaacaggccggttctgcacattttgtttttgacgcttctcatttcgttcagcgaagagattttgttcagaggcgttctgcagacacatatcggcttatgggccgccagcttcatttttaccgtgcttcatttcagatacttggcgaagtggcttctgtttatgatggttgcgggcatcagtcttttgctggggcttatctatgaatggaccggcaatttattcgttccggttacagcgcattttattattgatgcggtatttgcctgtcagatccgttttcaatatgttaggaggggtttgcatgacggaaatgtcaagagttgaaagaagaaaagctcagcagcgtgccgagcagcaggttgccgcggccgcggatgaacaaattgaatatcttgaagacagcctcccgacaagacaatctgtaaaagaggagcgtaaaaaaaaggaagagcaggtgaaggaaaaaaccaaaacaaaaacgccgctgttcacttttctgaccgtcctgttcattatcgtaacaatcggtgtctttttcggtcttctttatatgacgaacagcagcagatttgacccgaaggactatgaagatgtcttcatagaccacagtgaaagcgcgcctgccgttattccgaaaggcgctcagaaagatacgtcagaaaccgctcttttagaacaaccgaaaaaaaagtctgacgacaaagataagaaagaagcggctgcatctgaaaaaacaaaagaaaaaccaagtgaaaaaacacctgaaaaaacggaaacgtcctcagaaaaacaagtaaagccgacagacaccgaatacgcggagacaaaacagcagtctccgccggctgtccgtgaaaaagcggctccggctgccgcaagtgatcaagctgggactgtcccgaaaaaagtgcggaccgtacagcatactgtacagccgaaagaaacgctttaccgcatttcaatgaaatattataaaagccgggcgggcgaagaaaaaatccgcagctacaacggattaaacggaaacgacgtgtacaccggccaggttctgaacattccgctgtctgattaaaataaatgcatgttttcaccgcgtttttcatatagtgtactaatgaaaacggacaaggtgtgaagcgcatggattctttatggaagcaattagaccgatttgctgacggaccgacgaaacaaatgcttcaggcgctggtgaaacggaaattaaaatacgaaaattatgccgcacaatgccgaagatggcagtgggcgtccctcgtttgtttttccctgatgtgcatactgctgatgtttaaaagctttaatgccccccaagcctctccgcagctgattctgcaggaaatattaggccatacggtttatttgtgctggattatggcttccgcttttgcgtattgcacttcttattattttaaaaaaaaggaagaaaaagctgagggtgaatttcataaactgagatgtgaaattatccaaaaaagcacggatttatggccccagcctgaaaaatggagggcgagagaatctgtttttcacttgatgaaacatcggtatgatatcaatctttattttgaaagcaaataaaatgaggcgttttccggaaaggatagaaacgtctttttttgtttgtccgtctaatgtaagacaatgacagaatggagagtgcgtttatgaagctaacagcgggaattctcggctcattggcgggagcggctgcggttatggcggccgtcatgtacaaaacggcaaacggcagccatctgaaaacacatacatttacgcttgataaaatgaaagggatgaagccgctcaccatcttctttatatctgacgtgcaccgccgtttaattgatgaaaagcttctccgcgaagcggcagtttataagccggatgccgttttgctcggcggtgatttggcggagggcggagttccttacgccagaattgaagaaaacatcaaacgtctgacggctctcgcgcctgtcatttatgtgtggggaaataatgattacgaggtcagccagcaaaaattgctctcacttttacgggcatacaaagtgattccgctgagaaatgaatcggttcagtttgcttataaaggggaaaccgttacgatctgcggggtggatgatatcaggatgatgatggatgattacgaagctgcaatcagatatacggatgctgataaagtaaaccttctgctttgccataaccccgacatccatgagcagatgagggagtcagacgggattgacgctgtgttcagcggccatacgcatggcggccaaatccgtttcggccggttcgggccgtacgaattgggcggggcgggaacggtaaaaaaagcgcattatctgatcagcaacggctacgggacgacaaaagttccgctgaggctcggggcgaagccggagacgcatatgattacgctgtgcgggccggatgagccgttttcctgaaacaaatccggccgcggtgataaaaaacggcattctgcttgtcttcccgctgtacacggtgtaaactgataacaaattaagaacctatgactcatttattcatatactgtgttatatgatttgtgtgcaagaagaggcaggagggaacattatgcggcttgagcgtctgaactataataagattaaaatctttttaaccctcgacgatctgactgatcggggactgacaaaagaagacctctggaaggactcgtttaaagtccaccagttatttaaagatatgatgaatgaagcaaatacagagctcggctttgaagcgaatggtccgatcgcggtggaagtatattctcttcaggcacaaggtatggttgtgattgtaacgaaaaatcatgacgcggacgcagaagatgacgaatatgacgatgattatatcgagatgcaggtcaaacttgacgaaagcccggatattatttatcagttccattcgtttgaagatatcattcagcttgccggaagccttcaccgcatcgggattaccggcggcaccgtctaccattatgagaaccaatactatgtaagccttgaagacctcggctcccgttccgccgaaggtgtcatcgcggtgctggctgaatacggacacccggcgacaattacgatttacaggctccatgagtacggaaaactcatcatggacggcaatgctgtggaaaccatccagaaacatttttcataaaaaagatttgaaacggcagctgttttcagcggccgtctttttttaagcgaaataatggaaaaatcattgtctttcttctatgcacggagatattgaaggtgtatactagtcactgaaagggagcatgagagaaacagaagattttaggaggttaactcaaatggcagccgatcgattcaccggtcataatgaagaagacaaacatgatgtattaaaatcaacccaaaccgtaatacataaagctctggaaaaattggggtatccagaagaagtgtatgaactgctgaaagagccgctcagattattaacggttaaaattcctgttcggatggatgacgggtctgtgaaaatatttacaggctatcgtgcgcagcacaatgattccgtaggtccgacaaaaggcggcattcgttttcacccgaatgtaactgaaaaagaggtgaaagcactttccatctggatgagtttaaaatgcggaattattgatcttccttatggcggtggtaaaggcggaattgtttgtgatccgagaaatatgtcattcagagagcttgaaaggctgagcaggggatatgtaagagcaatcagtcagattgtcggaccgactaaagacgtcccggcacctgacgtatttacaaactcacagattatggcttggatgatggatgaatattcaagaattgatgaatttaactcacccggctttattacgggaaaaccgcttgtactcggcggatcccacggcagggaatcagcgacggcaaaaggcgtcaccatctgcataaaagaagcggctaagaaaaaaggtctcgatattcagaacgcgcgtgtcgtcgtacaaggtttcggaaatgcgggcagctatctggccaagtttatgcatgacgccggcgcgaaagttgtcggaatttctgacgcgtacggaggcctttacgatccggacggtcttgatattgattatctgcttgaccgcagagacagcttcggaacggtgacgaagcttttcaatgacaccattacgaatcaggagctgcttgagctggactgtgatatacttgtcccggcggcgatcgaaaaccaaattacagaagaaaacgctgaccgcatcaaagcgaaaatcgtggtagaagcggcaaacggaccgacgacactggaaggaacgaaaatcctgacagacaaaggaacgctgctggttcccgatgttctggcgagcgccggcggtgtaacggtttcttatttcgaatgggttcaaaacaaccagggcttctactggagtgaagaagaagtcgaggaaaaactggaaaatatgatgataaaatcgtttaataatatttatgaaatgtcccaaaaccgccggattgacatgaggcttgcggcttacatggtcggcgtgcggaaaatggctgaggcttcgcgtttcagaggctggatataaaccaatcgtttgcataaacaaaaaaaatctcctatgataatataggagattttttatatgagtggaaacttatgatggaaatgccaatcgcaggagttgaaggacatgacagaagaaaaagcaattataataggcggaggtccttgcggattatcggcggctatacatctgaagcaaattggcgtgaacgcgcttgtgatcgaaaaagggaatgtcgtaaacagcatttataactatccgacgcaccaaacttttttcagttcaagtgaaaaattggagatcggcgatgtcgcctttattacggaaaacagaaaaccggtccgaatacaggctctctcttactacagagaggttgtcagaagaaaagagctgcgcgtaaacgcctttgaaacggtggagcgcgtaacgaaacaggaagacggccgttttcttgtagaaacgtcaaaagaccgctacctcactccgttttgtatcattgcgacaggatattatgatcatccgaattatatgaacataccgggtgaagggcttcctaaggtatttcattactttaaagaaggccatccttattttgataaagatgttgctgtgatcggcgggaaaaactcaagtgtggacgcggctttggaactcgtgaagtccggtgcgcgcgtcacggtgctctacagaggacatgagtattccccgagcatcaagccgtggattctgcctgagtttgaggcccttgtcagaaacggcacaatccggatggaattcggcgcttgtcttgaagaagtgacggaagatgaaatcattttccgctccggccgaaatgagacggtccggctgaaaaacgatttcgtatttgccatgacgggataccatcccgatcacggtttcctcgaaaaaatcggtgtgcagattgatgctgaatcaggccggccgtttttccgggaagaaacgatggaaacaaatgttgacggtgtttttatcgccggagtcattgcggctggaaataacgccaatgaaatttttatcgagaacggccgttttcacggcggcttgatcgcaaacgaaatatcaaaacggctgggtgcagagagcatatgatcattcatatgctcttttttaaaaaattgaaagatgtaaaaatatgaacaacatggtaccatagatataggaatataaaggaaagaggttgcctgatgtttgcaatcatctctgcaggaattgctcccggcattgcgctgttaagctatttttatttaaaagatcagtatgacaatgaacctgtacatatggtgctgaggtctttttttctcggggttgtccttgtgtttccgaccatgtttatccaatatgttcttgaaaaagagcatgtggggggaggaagctttttcgtttcgtttttgtcttcgggatttttggaagaatcggtgaaatggttcgttctgatgatcagtgtgtacccgcatgctcattttgatgagcattatgacggaatcgtttacggggccagtgtgtctttaggctttgccacgcttgaaaatattctgtatttattcggccacggcgttgagcatgcttttataagagcgcttctgccggtctcctgccatgcgctgatcggagtgattatgggattttatctcggaaaagcccgcttttcgcagaaaaaagcccgtgtcaaatggcttgtgatttcgctggccgtgccttcatgtctgcacggttcttacgattttattcttaccgccctcaatcattgggtatattatatgctgccgtttatgctgtttttatggtggttcgggctgcgaaaggcaaaaaaagcacgctccgtcaatatgatccaagtgtgaagaaaccgcgcatcgcgtgcggtttctttttttatgccttgatgagggataagaaggaaacggtgtataaaaatatccgcgtgacagacaatacgggtacactttaaattttgcagtaggaggcttgaagagatgaagtgcaaaggagcctttatggcatgtctcattctattttctttcgccgccgctttcttcgatcatcatgaaacggttcatgcgttttcaaatcaagtgattcaaagaggcgcgacgggtgatgatgttatagaattgcaggcccgtcttcaatataacggattttataacgggaaaatcgatggtgtttacggctggaccacatactgggccgtgagaaattttcaggagaaattcggcatgaagccggttgacggcctcgtcggggcgaaaaccaaacaggtgctgatttcaaaatcaaaatattaccgtgaatatgtaatggagcagatccaaaaagggaatacgttcactcattatggcaacgtcccattggaaaaccaaacaaaaccgagagccggagcgcagaagcctgcggaaacgaataagcctgctcaaaagccgcaaaacaatacaggcggtcagtcaaatcaaaagcaaaatacgacagcggctaatatgcctggcggtttctcaaacaacgacatcaatcttctggcgcaggctgtgtacggggaagcgcgcggtgagccgtttgaaggacaggttgccattgccgcggttattttaaaccgtattaaaagcccgttatttccgaatacggtggccggcgtcattttcgaaccgctcgcgtttaccgccgttgccgacggccaaatatacatgcagccgaatgaaagagcaaaagaagcggttcttgatgcgattaacggatgggacccttctgaaaacgcgctttattatttcaatcctgatacggcgacaagcaaatggatttggggacgtccgcagattaaaagaatcggaaagcacattttctgtgagtaaaagtacgcaaaatgaggtgttaacatgattagaggaatcattatcgctgttctcggtgtcgcgatcgccgcaaccggatactggggatataaagagcatcaggaaaaagatgcggtccttctgcacgcggaaaataattatcagagggcttttcatgaactgacgtaccatgttgatcagcttcacgacaaaatcgggacgacgcttgcgatgaacagtaaaaaatctctgtctccggcgctcattgatgtatggagaattacatctgaagcgcataacaatgtgagccagctgcccctgactctcatgccttttaataagacggaggagtttttatccaatataggagatttcagctataaaacatccgtccgggatttagaccaaaaaccgcttgataagaaagaatatacaacactgaacagcctgtacaaacaggcggagaacattcaaaaccagcttcgcagcgttcagcatctcgtcatgagcaaaaatttacggtggatggatgttgaaatggcgctcgcctctgacaaaaaacaaagcgataatacgatcgtcgacagctttaaaacagtcgaaaaaaatgtaggcgctttttctgaagacagcatcagccccacatttacgggagcaaatacagaacgaaaaggttttacgcatctgaaaggaaaacaaattacggaaaaagaagcggtaaaaatcgcacaacggtttgcgcctgatcataattattccattaaagtggtcaaaagcggccggaagacgaatcgcgatgtatacagtatccgcatgaatgacgcggatcacaaatcttttatctatatggatattacccaaaaagggggacatcctgtctatttgattcaaaaacgggccgtgaagaaacaaaagatcagcctcaatgaagcatctaaccgggctgtcgcgtttttaaagaaaaacggatatgaaacaaaaggtctcgaaattgatgaaagcgcgcaatataataacatcggcgtcttttcttttattcccgtggagaaaaacgtccgcatttatccggaagccatccgaatgaaagtggcgctggatgatggtgaagtcgtcggtttttccgcgcgtgattacctggcggcgcaccgcacgagaacgattccggctcccgctttgtcagctgatgaagcgaaagcgaagctgaataaaaatgttgaagtgcgggagacccggcaggcgctgatcacgaatgaactcggtcaggaagtgctttgctacgaaatgctcgggacgatcgggaaagacacgtatcaaatgttcattaatgcggacgacggaaaagaggaaaaaatagaaaaattaaaaagcgcagagcctatatataaagacctataaaaataaaggaggaaaggactaaaagtcttttcctttttttcattacatgctttaataaaagcataaataatgaaagagtgaaggccatgatagctgtcggagattatatttggattgaatacatagagaacaatgagcccaaaaaagcgaggagtaaagcagtaagcgttgaaaacggcgaactccacatctcatatcccgtcgatctggattcgggacggacggtctttttgcataaaggattggaaataacagcggaatttatggggaatggccaagtaccgtatcaatttaaaagcataattaaaggaaagaaaaaagaacccatcccgatgatcggattggacatccccctcaggaggaaatgaagcggattcaaagacgccgatacgtccgtgcagacgcagtattggatgtatccgtcaaattggaagcgaaaaaaaccgcttttcaaacggtttcctctaatatcagcgccggcggaatcgctgttgtgatgcctgagcatatttccgcggaaccaggtgaaaagctgtatgtctcattttctcttcccggcaaggaaaatggggcggatataacggccgaggctcttacccagcggattttttatgatgaaaaggcggataaacaaaaaatgacgcttgaatttacagaaatcggccccgcagcacagcagcttttactccaatattgtatgcgcgcgcagctgcagcagagaagaaacagtctgtcggaataaacagcagcgcacttttccatactaatcctaatggaggtgcgcgtgtatgaaaacatttgaacgtctgctggtcaaattggtctgcattcagcttataattttgggcgcggtgcagtttttgcttcattatcagcctattgaaccttatatttcgaaagctgtgaaatatgagggagttgataaaatggagaaaaaagaatggattgaaacggtaaagcggtaaatcagctcaattttttcgccccttttccggcagttcatgatacaatccatagaggagtaaagagcaaggagagagattatggacaagaaattatcaattgcgatcgacgggccggccgctgccggaaaaagcaccgttgctaaaatagtagctgagaaaaaatcatatgtgtacattgatacaggggcgatgtatcgtgccattacatatacggcactcaagcagaatgccgatttaaccgatgaagccgcgcttacagagcttttgaagcgtacggaaattgagcttgtatccgctccggaaagacaaatcgttctcgtaaacggagaagatgtgacagaagaaatccgaaaagacgaagtcagcaaccaagtatccatcgccgccaagcataaaggcgtcagagaagaaatggtcaaaagacagcagcagctcggacaaaaaggcggtgtcgtcatggacggccgtgatatcggtactcacgtgctgcctgatgccgaagtgaaaatttttctgctcgcgtccgtagaggaaagagcgaagcgccgatatgaagagaataagaaaaaaggctatgacgtgaattacgagacgctcattgaagaaattgccagacgcgacaaactcgattcagagagggaagtttccccgctgcgcaaagcggaagacgcgattgaaatcgatacgacgtcactcagcattgccgaagtcgcaggaaaaattctggagatcgtcgaacagaaatcacgttaacttcgggcggagcgctttttaatttttttcaaaagacaagatgttattgcttgacaaaccagtccttttattagaagttaatactaataaaactttttattgatcattcaaaatcttttttggatgattctttaatacatattcggctgaaaagcggacattcacatgttcagctttcaaaccgtattaattaagctgtgtaggtttggaccaaggaggttattcaaatgacagaggaaatgaatcaaattgatgttcaagtgccagaggttggagatgtagtaaaagggattgtgacaaaggtagaggacaagcatgtagatgtcgaaattgtcaatgtcaaacagtccggaatcattccaatcagtgaattatcaagtcttcatgtagagaaagcatcggatgtcgtaaaagttgacgacgagcttgacctgaaagtaacaaaagtggaagacgatgctttgattttatctaaacgtgccgttgatgctgaccgcgcttgggaagaccttgaaaaaaaattcgacacaaaagaagtgtttgaagctgaagtgaaagatgtggtgaaaggcggtctcgtcgttgatatcggcgttcgcggcttcattcccgcatcacttgtcgaagctcatttcgtcgaggatttcactgactataaagggaaaaccctctctcttatcgtcgttgaactcgaccgtgataaaaaccgggtgattctgtcacaccgggctgtagtggaaaaagagcagacagccaaaaagcatgattttctccaaacgcttgaggttggaagcgtgcttgaaggaaaagtgcagcgtctgactgatttcggcgcatttgtcgacatcggcggaattgacgggcttgttcatatttcgcagctgtctcattcacacgtcgaaaaaccgtctgacgtggtggaagaaggtcaggacgtaaaagtgaaagtgctgtccgtagaccgcgataacgagcgtatttctttatctattaaagaaacgctgccgggaccttggagccagatcggcgaaaaggtaaaacagggagatgtgcttgaaggaaaagtgcagcgccttgtaagcttcggcgccttcgttgaaattcttccgggcgtggaaggacttgtgcacatttcgcaaatttccaataaacatatcggaacgccgcatgaagtgcttgaagaaggacagactgttaaagtgaaagtgcttgacgtgaacgaaagcgaagagcgcatttccttaagcatgcgtgagcttgaagaagcgccgaaagccgatcaggaggacttccgtcaataccaggcgaaagaagagccgagcaccggcttccagcttggcgatttaatcggagacaagcttaataaattaaaataaattggtgataaaacgtgacacgagcagaacgaaaaagagaacatataaatcatgcgctgtctaccggccaaaaccgggaaacggggcttgatgatattacgtttgttcatgtcagcctaccgaacctagcattggaaaaagtggatatatcaacgaaaatcggcggactcacaagcagttcgccgatttttatcaatgcgatgacaggcggcggcggacagcttacatacgaaattaacagatcgctggcaagagccgcgcgcaaagccggcatgccgctggctgtcggttcgcaaatgtcggctttaaaagatccctccgaacggtattcttacgagatcgtcagaaaagagaatccggacgggctgatatttgccaatttaggcagcgaggcggatgccgagcaggcaaaaagagcaattgatatgattcaagcggatgccctccagattcatttaaatgtgattcaggagatcgtcatgccggagggagacagaagctttaccggcgctctcggccgtattgagcggattgcggcggaagcgggagttcccgtttttgtcaaagaagtcggcttcggaatgagcagggagtcggcacggcagttatttgatgccggtgcggcagcagttgatgccggcggatacggcggtacaaatttctctaagattgaaaatatgcgcagagagaaggcgcttcaattttttaatacatggggaatttccactgccgcaagcttagcggaaatccactcgctctccgctgatcaatcaattatcgcatccggcgggctgcaaagtgccctggatgtcgccaaatcgattgccctcggcgcttctggcgcgggaatggcaggcactttcctgaaagctctcacctccaaaggagaagaggggctgtttgacgagatgacggtgcttttacaagagctgaaaatgattatgaccgccctcggatgccaatcggttgcccaattgcaaaaggcgcctttggtcataaaaggtgacacacatcactggctttctgaacggggaattgacacatcccgtttcagcagacgttaaaaggcatgcgaacccgcatgcctttctctgttttttacgattttctttttcggaattcaccgttttgttcaaggctcgtcgctcctttatggtgaattgaatcatcgcgatcagattccacccggcgggaggctttcagttttttctcctgtctgtcttttcccatttttatccgctcctttcaggcataattggtttaaaaaatgcgttcccgctccatactggtcagaggaggagcgattatggaaccgttttattattactggtcaatgtggtttttatggatacttgcgacttttatttttgccaaaacaaaaagccgtttttacgtatcagtctttattttgactaatatgatggcaagcatacatcagataacggcttattttacgctgaacgcggcatatgtcatgttttttgctgcggcatttgtttatgcgggaagcctcggcatgcataaacggctccgtcatattgtgattcatctgacggcggctgcggcgtacggctttatttttctttttgcattatatgaccctgtttggtttatcataaaacctgaatgggcagcggttatactgcttaccgttattacgctttctgttgaggggcggttccctgagaggctttgtctttttgttctcggcatgtgccagggggagttattgtatgctgcggtcatccgcaacattgcgggggcagcagccgtcggtgattataaatggctatcaggctgttcggcgggagtgattcttctcgtcgggctgactacatatgaacagcttgcggcgcgcatcagccaaaaaagcaaaaagcagggcaaaggagcgacaaaaatgtcttgaaaacagacggagactgttacatgaatacgaaacattttgaagaatacattgtgatctcagtgaaaactgatataataaatgagttaagcccttctgtttgaagggttcttttcatagcgaagatgattattaataaccggttgaacaattttttgtgaaaatgtaagcggctggattgaaaggaagggtactatgggtaaacctgtcgtagccattgtcggaagaccgaatgtgggaaaatccacaatctttaaccggattgcgggtgaaagaatttcaatagtagaagatacccccggagtgacgcgggaccggatatacagttcggcggaatggctgaattatgattttaacctgattgatacgggcggaattgatatcggagacgagccgtttctgacacagatccgccagcaggctgaaatcgccatggacgaggctgatgtgatcatctttatggtgaacggccgcgaaggtgtgacgtctgcggatgaagaagtggcaaaaatactgtaccggacgaaaaaaccggtcgtattagccgttaataaattagataataccgaaatgagagcgaacatttatgacttttatgcgctcggctttggagaaccgtatccgatttcggggacacacggtttaggattgggagatttgctcgatgcttgtgccgagcattttaaaaacattccggagacgaagtacagtgatgatgtcgttcaattctgcctgatcggccgcccgaatgtcggaaaatcatcccttgtcaatgcgatgctcggcgaagagcgggttatcgtgagcaacgtagccggaacgactagagacgctgtggatacggcgttcacttacaatcagcaggaatttgtaatcgttgacacggcgggaatgagaaaaaagggtaaagtatatgaaacaacagaaaaatacagtgtgctgcgggcgttaaaagccattgaccgctcagacgtcgtcggcgttgtgctgaatgcagaagaaggcatccttgagcaggacaagcggatcgccggatacgcccatgaagccgggaaagccgtcgtcattatcgtaaacaaatgggatgccgttgataaggacgagcgcacgatgaaagaatttgaacagaatattcgggagcatttccaatttctcgattatgcgccggtgctgtttatgtcggcactgacgacaaagcggattcatacactcatgcctgcgattattaaagcgagtgaaaaccactctctccgtgtgcagacaaatgtcttaaatgatgtcatcatggatgcggtcgccatgaatccgactccgacgcacaacggctcccgtctgaaaatttattatgcgactcaagtcgctgttaagccgccgagcttcgttgtttttgtcaacgatccggaactgatgcatttttcttatgaacgctttttagaaaaccgaatccgggacgctttcggatttgaaggtacgccaattaaaatatttgcaagagcaagaaaataaaaaggtgtgatacagagatgaaaaaagtggcaatgcttggagcgggaagctggggcactgcactttctttagtgctggctgataacggacatcaagtcatgatgtggggacaccgtgccgaattgatcgatcaaatcaacgaactgcatgaaaacaaagattacctgccgggtgtggagctatcaagttctatcatcgggacagccgatttaagcgaggctttaaaaggagctgacttcatcattgtggcagtaccgacaaaagccattcgggaagtgctgaaaaaggctctgccgtatatcccgaaacaatcgatttttgttcatgtcagcaagggaattgagccggattcgcttctccgcatttcagaattaatggaggaggagctgcctgaggagtacagaaaagacatcgtcgtgctttcagggccgagccacgctgaggaagtcggattaagacacccgacgactgttacatcatcttcaaaaaatatcaaggctgcagaagcggttcaggatttattcatgaaccagcatttccgcgtctatacaaatcccgatatgatcggtgttgaaatagggggagcgttaaaaaatatcatcgctcttgcagcggggattacagacggattgggatacggagataatgcaaaagcggccttaatcacccgaggtcttgctgaaatcgccagactcggcacaaagatgggcggaaatccgctcaccttttccggcctgaccggcgtaggcgatttaatcgtgacgtgtacaagcgttcattcccgaaactggcgcgccggcaacctgctcggcaaaggatataagctggaagctgtcctggataagatggggatggttgttgaaggcgtgcggacgacgaaagctgcgtatcagctgtctcaaaaatatcaggtgaaaatgccgatcacagaagcgcttcaccaagtattatttaatgggcagaaggtagaaacggccgtagaatccttaatggccagagtgaaaacccatgagatggaagacttggtcaacacattcgaaaaccgggtgaagtgacaataacatgccgtcagcatattctgaagtgacgaaagtccaaaacgcagaactctccggctgaaatcgcttaaaacatttgctgatttaggcagaagaggatgcagacgtacgcatctacgcatactatagcatcgaagtccaagagagtgtatctcagacgtacaggtgaatatagtcaacttgactgaagcaaagtccccctctttgcttcagttttttgttttttcaatagatggaaaacctgttgatcttttcaacatttgtatattaaaatgaaatataacgcttacaatgatgggacggggggcacgaacgtgagtgtggcattgatgaaaatgtggtttgcgcttggtgctatgggattaatgtttgttgcggtcgcctttatttatgtcagcaggtacaaagtgaaaaacaaactgataaaagcagcggtttcttcactcgcttatgcctgcatggtcatctcgggattgatcgtgttaatggtcgttttcagcgggcctgtcaatgaataaagccaaaagggggcgcggaatgcataagttaaaaatggccgtcataacggcaatggcggtgcttctgctgtcgggctgtctgtaccctgaagcaaaaaaaactgaaaataaagtatcttacaaacatcagcttcagcaggtgcaagcggcagtggatgaatttaaaaaggcgaacggcggacttctgccgattcagacaaaagatatgaaaacaccgctctatcaaaaatatccgatagattttaagcggctcgcgcccagatacatagaggagccgccggcctcagcttatgaaagcggaggaatgtaccaatacgtgcttgtcgatgtggaaaataagcctaccgtcaagctggtcgatctccaaatggcggaagcaatccgcgacatgaagctgcgtgtcaaaatgtatcaggaaaagcatacatatcctccctatgaggacgctgtttcaaaaggcctgttcactttaaataaaaaaaagctcggcatgaaagactctccttcagtcaaaagtccggtttcaggcacgtctctgccgcttttaatcggcgctgacggagaaatctatgccgactatcgcgtcgatctcgcccgctgcctgaaggaaaacaaaaagaaaatcaaaccgggcgcggaaattcaggatattttatggaaagagactcctttcgtcccggccttttcagtcacttacaccgtaaatgaaaaacaggaacccgtttttttagaaagtcaaacgaaacaggaatgaacctttttcccgcgcatacaaatagggagaaaggtttttttgattttgatagaaaagactgcctgaaaattttctaaagatgtcatattgaaataggacaacgtcatacacatatagtgtcctgtatttgattggagaatggtgaatgaaaaatgataaggataggaagtccgggaggggatcacttggaaaaggtcgatattttcaaggatatcgctgaacgaacaggaggcgatatatacttaggagtcgttggcgctgtccgtacagggaaatctacattcattaaaaaatttatggagcttgtggtgctcccgaatatcagcaatgaggccgaccgagcgcgggcgcaggatgagcttccgcaaagcgcagcaggaaaaacgataatgaccacagaaccaaaatttgtcccgaatcaagccatgtccgttcatgtcgcggaaggacttgatgtcaacatccgtcttgtggattgtgtgggatatacggttcccggggcgaagggatatgaggatgaaaacggtccgagaatgatcaatacaccttggtatgaagaaccgattccctttcatgaggctgcggaaatcggtacgagaaaagtcatccaggaacactccacaatcggggtcgtcattacgacagacggctcaatcggcgatattgcgcggggcgattacgtggaagcggaagaaagagtcatcgacgagctgaaggaagtcggcaaaccgtttattatggtcatcaactcggtaaaaccgtaccacccggaaacagaagcgctcagagctgaattaagcgcgaaatatgatattcccgtcctcgccatgagtgttgaaagcatgcgggaaacagatgtgttaagcgtcctcagagaagcgctttacgagttccctgtgctggaagtcaatgtcaaccttccgagctgggtcatggtgctgaaagaaaatcattggctcagagagagctaccaggaatcagtgaaagaaaccgtaaaagatattaaacgcctgcgcgatgtcgaccgggttgtcggccacttcagtgaatttgagtttattgaaagcgccggattggccggaatcgaacttggccagggtgtcgcagaaattgatttgtatgcgccggatcatttatatgaccagattttaaaagaagtggtcggcgttgaaatccgcgggaaagaccacctgcttgaattaatgcaggacttcgcccacgcgaaaaaagaatatgatcaggtatcagatgcgctgaaaatggtgaaacagaccggctacggcattgccgccccggccttaaccgatatgagccttgatgaaccggaaatcatcaggcagggatcaaggttcggagtaaggctgaaagcggtcgctccgtccattcatatgatcaaagtggatgtggaaagtgaattcgcaccgatcatcgggacagaaaaacaaagtgaagagcttgtccgctacttaatgcaggactttgaagatgatccgctttctatctggaattccgatattttcggcagatcattgagctctatcgtaagagaaggaatctccgcaaaactgtcactcatgccggaaaatgcgagatacaaactgaaagaaacgctggagagaattattaacgaaggctcaggcggcctgatcgccattattttgtaagctgaaggacctcttcctgaaacggggggtctttttttattctttttagatactggaaatcaatcaaggattaggaggaaaaaagcaaaaaaaggaatatttgttcggtaaaacacgtgaaaaccttgacgagcaagggattgaggctttaaaatgcttgatatggctttttatatgtgttactctacatacagaaaatcttcactttgttggacaaacattcctcaaagtgtctgttttcttatgaaaagccgtttacttgtctgttcttccctgctttgattttttatcagacaggtttagaatcaggctgaactgtgaagaaatgataataaactgctgatttgatacccttttgggaggaggtgaaaggcatgaacaagacagaactaatcaatgcggttgctgaagcaagcgaattgtctaaaaaagacgctacaaaagcagttgattctgtttttgatacgattttagatgcacttaaaaacggtgataaaatccaactgatcggtttcggtaactttgaggtgcgcgagcgttctgcacgtaaaggacgtaacccgcaaacgggtgaagaaatcgaaatccctgcaagcaaggtacctgctttcaaaccaggtaaagctcttaaagacgctgttgcaggaaaataattgtgaatatagatcgtgtatgcatctgatacatacactttgtttcttcacagaaaagccccttgataaaggggcttttcatatttaagcagccccggtcaccgggcaggactttcgttttgcttttggcgcggcaaatgtgctagaatcgaaattaaatgtattcaatggtggaggacacagacaatgaaagaagttaataaagaacagattgaacaggcggttcgccagattttagaggcgattggagaagatccggaccgggaagggcttttagatacgccgaaacgcgtggcaaaaatgtacgcggaagtattctcgggattaaatgaagacccgaaagaacactttaaaaccgttttcggagaagagcatgaggagcttgttcttgtaaaagatatcgcgtttcattccatgtgtgaacatcaccttgttcctttttacggaaaagcgcatattgcctacattccgcgcggcggcaaagtgacgggcctgagtaaattggcgcgggcggtggaagccgtctcaaaacgcccgcagctgcaggagcgcattacttcaacgattgcagaaagcatcgtagagaccttagatccccacggcgtcatggttgtcgtcgaagctgagcatatgtgcatgacgatgaggggcgtaagaaagcctggcgcaaaaacagtgacttccgctgtaagaggtatttttaaagatgacgcagcggcgcgttccgaagtgttagaacatattaaacgtgcggattaataatgatagagggtgcagatatgaattcaaagcattcaagtgattttgtcgtcattaaagcggtcgaggacggcgtgaacgtcatcggtttaacgagaggtacggatacgaaatttcaccattccgaaaaactggacaaaggcgaagtgattatcgctcagtttactgagcatacctctgccatcaaagtgagaggcaacgccctcatccagaccgcttacggagaaatgaacagcgaaaaaaaataagccggctgtttcccgcttttgccaattgcccgcaaacggcgggagaatacagccaatttcttttttttatgctataatgatacctgcgtataataatgacgagtaaatctcatacatattagaataaatgtgaatttggggacaagggtgatatttttgcaagacatctacggaactttaacgaatctaaatacgaaattaaaacaaaagctgtctcatccttatttagcgaaacatatttccgcgcctaaaatcgatgaggataagcttcttctttttcacgctttgtttgaagaggcggacattaagaacaacgacagagaaaattacatagtaactgcgatgcttgtccaaagcgcccttgatacccacgatgaagtgacaacagccagagcgttaaagcgagacgaaaataaaaaccggcagctcaccgtgcttgccggcgactatttcagcggactgtattattcgcttttatctgaaatgaaggatatctatatgattcggacgctcgctacggcaattaaagaaatcaatgagcataaaatccgtctgtacgatcggtctgtcaatgacttgaatcaattgatcgaaagcatggcgattgtggaagcggccctgtttcacagagtgtcagaccactttaatcttccgcgctggaaagagctggcgagtgatttttttgtatataagcggctgatgaacggcaatgctatatttctcgatgtcatcggcaatattgtaaagtcagggaaatcaaaggctgacataatggaagatagcttccgaaaggcaaagcaaagcattgaaacgctgctgccgctcaattcaccaatccaaaacctcatgctgaaccggctcaaagcgatcagccaggacaaaacatatcatcagaaagtggaagaagggtaatcaacatgcaggagtcaaaagaacagcgcgtacacggcgtgtttgaaaaaatctataaaaattatgaccaaatgaactctgttatcagttttcagcagcataaaaaatggcgcgataaaacgatgcagatcatgaatgtaaaagaaggcgcaaaagcgcttgatgtctgctgcggaacggctgactggacgattgccctcgcagaagcagccggaaaaagcggcgaaatcaaaggactggatttcagcaaaaatatgctgagcatcggcgagaaaaaagtgaaagagggcggttacagccaaattgagcttttgcacggaaatgcgatggagcttcccttcgctgatgattcttttgattttgtcaccatcggcttcgggctgcggaacgttcccgactatctgaccgtgctgaaagaaatgcggcgggtcgtcaaaccgggcgggcaggttgtatgtctggaaacatcccagccggaaatgttcggattcagacaggcatattttctatattttaaatacatcatgcctttcttcggaaaaatgtttgcgaagagctataaagaatattcttggcttcaagaatcggcaagagaatttcccggtatgaaagagcttgcgcgtctgtttgaagaagcgggcctgacgaatgtcaaataccattcgtttaccggcggagtggccgctacgcatatcggttggaaatgatgaatatacagatgtttgggtgaatgatatgaaatttaaaatggcctattcttttttaaatgacgatattgatgtgatcgaaagggaacttgagcaaacggtgcggtcagactatcccttgctgagtgaagccgggctccatctgctccaggcgggaggcaagcggatccgccctgttttcgtattgctttccggcatgttcggcgactatgacattaataaaataaaatatgttgcggtgacgctggaaatgattcatatggcgtccctcgtgcatgacgacgtcattgatgacgccgagctgcggaggggaaaaccgaccatcaaagccaagtgggacaaccgtatcgccatgtataccggtgattatatgcttgcgggctcacttgagatgatgacgagattggatgagccgaaagcccaccggatcctgtccaaaaccatcgtagaagtatgcctcggagaaattgaacagatcagagataaatacaatatggaacaaaacctcagaacctatttgcgccgcatcaaacggaaaacggctcttctcattgccgtcagctgccagctcggcgccatcgcttcgggagctgatgagaagattcacaaagcattatattggttcggctattacgtgggcatgtcctaccagattattgacgacattcttgatttcacttcaacggaagaggaactgggaaagccggtcggaggggatctgctgcaaggaaatgtcactctgcccgttttgtacgcgctccgtcagcctgaattgaaaaatcagctgaaattaattaacagtgaaacaacacaggagcagctcgcccccattattgaaaatattaaacgcacagacgcaattgaaaaatcaatggccgtcagtgacaggtacttaaaaaaagcgtttgaaaaactgaatacactgccgagaggacgggcgcgctcatcattggccgccatcgccaaatatatcggcaaacggaaattttaaattccttttacgaacaagatgtgaacattctccgccctggattgattaattgtcagaaagatgttacgatttcggtgtgcaacttgaaagcctatacataatgatggggtggagaatcttatggaaaaaacttttatcatggtaaaaccggacggcgtacagcgccagctgatcggagagattttatccagatttgagcgtaagggcttacaattggcaggagccaagctaatgcaagtttcagaacagatggctgaaaaccattatgctgaacataaagggaagccgtttttcggcgagcttgtggaattcattacatcaggacccgtatttgcaatggtatgggaaggggaaaatgtagtagagatcacaagacagctgatcggaaaaacgaacccgaaagatgcactgccgggcacgatccgcggtgactacggcatgtttgtcggcaaaaatatcattcacggttcagactccttagaaagcgccgagcgggaaattgacattttcttcaaacgggaagagcttgtaccgtatcaaaaattaatggccgactgggtgtactaagccgtcagcctttctttttctcttgttatgaaaaggtttacatattttaagaaagacagaggctgcgctgccctgtcttttcatttctcacaaatcagcctgcgggctgatttttttattgaaatcgtacaaattagaaagaaaacaggctatactaggacaaaagacagcgagattgggagagaagcaatggagccttacgaaatttttatcaccaagtggaaacaaataaccggcgttgatttatctttatacaaagaagcacagatgaaaaggcggctgacgtccctttatgaaaaaaagggattcaaagattttcaggaatttgccgccgctttggagaaagacaagcttttattaaatgaaacattggacaggatgacgatcaatgtttctgaattttaccgaaattataaacggtgggaagttcttgaaacctcaattcttccgttaataaagcataacaaaccgttaaaaatatggagtgcggcctgttcaacgggggaggaaccctatactttggctatgattctcagtcagcaggcgggtttggccggatttgatatattggcgacagatattgatgaaaaggcgcttggcaaagccaagcggggcatctatcaggaacgctcgctgcaagaggtgccggcttccgtgaaaagccgttatttcaccaagcaggctgacaacagttatcaagtaaaacaagagattcaaaaaaacatccggtttaagcggcacaatctgctcgccgacagctatgaacaggattttgatctgatcgtctgccgcaacgtctttatttattttactgaaaaagcaaaagaagagctgtatgtaaaaatggcgggcagcctgaaaaagaacggaattctgtttgtcggaagcacagagcagattttcagcccggaaaaattcggccttgagagcactgatacatttttttatcaaaaaagatagaagacatttaatgaaaacttgtggtatagttttacttaaaagcgttaatgcgatgaagggagaagaaagaaatgagatacttaacagccggagaatcacacggcccgcagctgacgacaattatagaaggtgtgcctgcggggctttatataactgaagaagacattaattttgagcttgccagacgtcaaaaagggcacggccgcggacgccgcatgcagattgaaacggacagggcgaagatcacaagcggcgtgcggcatgcccggacactcggttcacccatcgcgctcgttgtagagaataaagattggactcactggacaaaaatcatgggcgccgcaccgattacagaagaagaagaaagtgaaatgaaacgtcagatttcaagaccgagaccgggacacgcagatttgaacggggctattaagtataatcaccgtgatatgagaaatgtgttagaacgatcttccgcgcgtgagacaacggttcgcgtggctgccggagccgtcgctaaaaagattttagcggagcttggcattaaagtcgccggacacgtcctgcaaattggcagcgtaaaagcagagaaaaccgattacacatccattgaggatctcaaacgggtaacggaagaatcaccggtgagatgctacgatgaagaagcaggccgtcaaatgatggcagccattgatgaagcgaaggcaaacggcgactcgatcggcggaatcgttgaagtgatcgtcgaaggtatgcctgtcggtgtcggaagttatgtccactatgaccgtaagctggacagcaagctcgctgcagccgttctgtcgattaacgcgtttaaaggcgtagagttcggcatcggttttgaagcggccggcaaaaacggcagtgaagttcatgatgaaatcgtatgggatgaagagaaaggctatacacgcgccacaaacaggctcggaggattagaaggcggtatgacgacgggaatgccgattgtcgtccgcggcgtcatgaaaccgatccctactttgtataagccgctgaaaagcgtcgacattgaaactaaagaaccatttacagcgagcattgaacgttcagacagctgcgcggttccggcagcaagtgtagtggctgaagctgcagtggcctgggaaatcgcaaatgccgtcgtagaacaattcgggcttgaccagatcgaccgcattaaagaaaatgttgaaaacatgaaaaaactatcgagggaattctgatgaaagagcttgaggttcggacagcttcctccgcatatcccgtgtatatcggtgaaggcataaggaaacaggccgctgctcttttgtcttcactgaacaggccgctgacaaagatccttctcgtcatcgatgctgaagttgaccggctttacggcgatgagatgttccggcttttaaacgaaacatggcccgtgaaaaaagtaatcgttccaagcggagaagaagcgaagtctctaaaagagtatgaacggattcaaacggaagcgatcgctttccatatggaccgctcctcatgtatgatcgccttcggaggcggcgtgacgggtgatttgaccggcttttgcgcagcgacttttatgcgaggaattgatttcattcaaatgccgacgacactgcttgcccatgacagcgcggtcggcggcaaggtggccgtcaaccataaactcggaaagaacttaatcggcgcgttttatcagccgaaagcggtgatttacgatacggagcttctgaaaaccctgccggaacaagagctgagatcgggcatggctgaagtgatcaaacacgcgtttatcgccgatcatgcttttttagaaaaacttctcacgtttgacacgttgcaaggactgacaagcgctgagctgaatgaaatgatttataaaggaatttcaatcaaatcggccgtcgtgcgtgaggacgaaaaggaagagggcataagagcttttctgaatttcggccatacgctcggccatgccgttgaggcggaatacggctacggccggattactcatggagatgcggtcgccctcggcatgcagtttgccctttacgtgagtgaacaggttgcgggttgcaagatgaacaggaaagaactcacacaatggctgattgggctcggctacccgggaagtatcagacaagatattgaaacgccggttctctccgcccggatgatgaatgataaaaaaacgcgcggaggcatgacacagttcatcgtgttaaaggaattaggggaagcgcgggactgcatgctttcaaaagatgagctcgaaaatttgctgaacaaatggcgaatggaggaaacagcatgatgatacgcggcattcgcggagcaacaacggtggaacaagacaccgaacaagaaattttagaaaaaacacagcagctgcttgaaaaaatcattgaacaaaatggatgcaagccggaagacgttgtacagatcctgttatccgccacgcctgatatccattccgtatttccggcaaaagcggtccgccgcctttccgggtggcagtacgtcccggtgacgtgcatgcaggaaatggatgtcaccggcgctctgcaaaagtgtatccgtgtcctgatgacggttcagacggatacgcctcaggatgaaatcaagcatgtctatttagaaaaagccgttgtgttaaggccggatttatcattgacaaaaaatactgacatgtaatacgataaacaaagcttagaaatacacaagagtgtgtatagagctggtaagtaagatattgaacagttgagtttagaatagggtagcagagaatgagtttagctgagctgagataaacacgtttttattctgcccaaaagaagcctttcttttgggtttatttcttatacgcaagactcctctcactcttcatctcattctccttaccgtaaggaggagaatcatgaatttacaatcggatgtttctttatttttaaaggacagtctgacacaccgcaccattccaatcgcagagacttttacggtcgacacgatcacacccattcagatggttgaaaaactggacagaaacattacgtatcttttagaaagcaaggatgagtcgtcaagctggtcgagatactcttttatcggcctcgatccttttatcacgattaaagagagtcatcacacattcactgccgctgatccaaacgggcatacgctgtttgaagccggagaattaaaagccgtgcttgattggatgaatgaaagcttccgcattaaaacacccgagcttgatatcccgttttcgggaggggccgtcggttatctgagctatgacatgatccctttgattgagcctaccgtgccgagccacgcgaaagaaacagatttcgaaaaatgcatgctgtttgtctgccggaaaatcatcgcgtacgaccacgaaacgaaacaagtgcatttcattcaatatgcggcgcttaacggccgggagacggaggaagaaaagcgggccgtttttaaagaaaattgcgcggagcttcgtaagcttatcggtattttgacagaaccgaaagatatgaaagagccgtttttttctaaagaaacatttgaaacgccaagttttgccgatatgacatctaattatacgaaagaagagtttatggccggcgtcaataaactgaaagaatatataaaagccggagacatttttcaaggggtgctttcgcaaaagtttgacattccggtatccagacattcatttgagctgtacagggtgctccgcatcgtcaatccttcaccttatatgtactatatcaaactgcctgacagagacattgtcggaagttcgcctgaacgtctgatccgcgtggatgacagacacctggaaattcatccgattgccggaacgagaagaaggggcgccggaaaagaagaggacgatcgcctcaaaaaagagctgatgaatgacgaaaaagagaaagctgaacattatatgctcgtcgatcttgcgcgcaatgacatcggcagagttgcggagtacggttccgtagccgttccggaattcacaaaggtcgtttctttttcacatgtgatgcacatcatctctgttgtaaccggccgtttaaaacagggcgtccatccggttgatgcgctgatgtcggcattcccggcaggaacactctcgggcgctccgaaaatccgcgcgatgcagcttttaaatgaattagaaccgacttccagagaaacctacggcggatgtatcgcttatatcggatttgacgggtcaattgattcgtgtatcaccatccgcaccatgagtgtcaaaaacggtacggcgtcggtgcaggcgggcgcgggaatagtcgctgattccgtcccggaagccgaatatgaagagagctgtaacaaagcgggggcgcttttaaaaacgattcaaatcgcagaagacatcttttctggcagggaggagaagacggatgaacaaatttctgcaatcgtgcgttaatggccgcacgctgaaaaccggagaagccgaaaagctgatggagatgatgatgaacggggccatgtcgcagtctgagatcggggggattttatcggtattagcccaccggggtgaaacggcggaggagcttgccggatttgtaaaagtgatgcgggcgcgggcacagacggcgggtggcttggcggatgtcgttgatacgtgcggaacaggcggagacgggatttctacgtttaacatatccacggcagcggcgattacagcttctgccgccggagctaaagttgccaagcacggaaatcgctccgtttcgtctaaaagcggcagcgcggatgtgctggaaaagctgggggtttccattcaagccactccagaaagcgtcaaacgcagcattgaaatgaaacaaatggggtttttgtttgcgccgctgtttcattcgtcaatgaagcacgtcgccgccgcaagaaaagagcttggcttccgaaccgtatttaatctgctgggcccgctcagcaacccgctgcaggtgaagcggcaggtgatcggcgtctattcatttgataaagcgcgcctgatggcaagcgctttggaacaatttgatgtcagacacgtcatgcttgtgtcggcgcgtgacggattagatgaactgtccatcacagcaccgacagatatcattgagctgaaaaacggtgaacgtctggaatattccgtttcacctgaacaattcggttttgcagaaggttcattgaaggatattcaagtgagttcatcggaagaaagcgcgcttctcattcagaatatttttgcaaatagagctccgtcatccgctctgcatattaccgccttaaatgcgggcgcggccatttatacggcaggtcttgcaaacgatctgaaagaaggaacgaaaacagccttagaagccattcaaaacggagatgccaaaaggcagctcgaacgtctgaaacagaaagaggaagaaatgtatgcttgatcaaatcattctgcagaaaaaagaagaaatcaaatccatcgtgctgccggaaacctgtcaaattgaacggagatcctttaaagaagcgctcctgaacccgaaccgttttatcgggctgattgccgaagtgaaaaaagcttcgccgtctaaaggattgattaaagagcattttgttccggaaacgattgcggcggattatgaagcggctaaagccgacgccctttcggttctcacggatacccgtttttttcaggggagaaatcaatttctgacagatgttaaacaaaccgtgtctcttcccgtgctgagaaaagattttattattgattcccttcaggtggaggaatcgttcaggatcggcgccgatgccattttgctgatcggggaagcgctggaacctccaaagcttcatgagctttatctggaagcccgcgggaagggcatggacgttctcgttgaagtccatgatgaaactgtgcttgaacggattttacaagtgtttcagccggacattctcggcataaacaaccgggacttaaaaacgttccgtacttctgtttcgcaaacggaaaaaatagcgcagcttgtgccggacggctgcctgctggtcagcgaaagcggcatcggttctttggctgacctgcaattcgtcaacaagcacggggcgcaggctgtattggtcggagaatccttaatgagagaggattcgcagcaaaaggcgatccgcggactgttcggagagtgacgatatgaaaaagcctgagttaaagtactgcggaatacgatcgaagcgtgattatgaacttgcggcagcttcagaagcggattatctgggatttatttttgccgcaagcaaacggagagtaacgccggatgaggtccggaaatggaaagagcaggtccggacagacaagaaacatgtcggagtatttgtaaatgaaacgatagaaaacatcgcgcaaatcgcatctgatctggcacttgacgtcatccagcttcacggtgatgaatcgcctgaggatgcccttcgcctccgtccgcttgtgcgctcggaaatatggaaagcgctccatcacggggaagggacgctccgtcagatggctcaatttacacctgctgtcgacggctatgtcattgattcttcagtgacaggaatgagaggcgggacgggaatcgcgttttcatgggcccgtgtccccttgtaccgaaagcaggctcaaaatgcaagcaagcgctgttttattgcgggcggtgttaatcctgaaacgattaccggcttactgagaacgcgtccgtgcggtatagatcttgccagcggaattgaaaaaaacggacacaaggatcaaacactgatccggcttttagaagaaaggatgaaccactatgtatccatatccaaatgaaatcggaagatacggcgaattcggcggcaaatttgtccctgaaacattgatgcggccccttgaggaaatcgaaacggctttcacagaattaaaaaatgatcctgtttttcatgccgaatataaaaaactattgtttgattactccggaagaccgactgcattaacgttcgcagacagggtgtcagagtatttgggaggggcgaaaatctatctgaaaagagaagatttaaaccataccggctctcataaaattaacaacgcgttaggccagattctgcttgctaaaaagatgggcaaaacgaaaatcatcgccgaaaccggtgcgggacagcacggtgtggctgccgcgacagccgccgcaaaattcggttttaaatgtacggtttttatgggtgaagaagacgttgcgcgccagtcgctgaacgtattccggatgaaactgctcggcgcggaagtggtgccggtcacaagcggcaacggcacgctgaaagatgcgacgaatgaggcaatcaggtattgggtccagcattgtgaagatcatttctatcttatcggttctgtagtgggtccgcacccatatccgtatatcgttcgcgaatttcagaaaatcatcggcgaggaagcgaaagaacagctccgccgggttgaaggaacgctcccggacaaggttgttgcatgtgtcggcggcggaagcaatgcgatgggcatatttcaggcctttttagacgaagacattgagctgatcggcgccgaggcggccggaaaagggattgatacgccgctgcatgcggcaacgatcgcaaaagggacgctcggggtgattcacggatcaatgacctatttaatacaagatgaatacgggcagattatcgaaccgtattccatttcagcaggccttgattacccggggatcggccctgagcacgcctatctgcacaaaagcggccgtgtaacgtacgaaagcgtgacagacgatgaagcgattgccgcgttacgtctgctttctgaaacagaaggtattcttccggctattgaatctgcccacgccctggcaaaagcgtttgaaatggcaaaggacatggataaagacaaaatcattctcgtcagtttgtcgggaagaggagataaagatgttcatacgctgatgaatgttttggaaaacggggtggagacacatgtttaatctgcgagattctgaaaaattgtttatcccttttatcacagcgggcgatccgcttcctgacatttctgttgaactggcaatatcattacagaatgcaggcgcttctgcccttgaaatcggcgttccttacacagatccgcttgcggacggacccgtcatacaacgggcttcaaaacgggctctggaaaacggaatgaatatcgtaaaagccattgaacttggcggcaaaatgaaaaaaaacggcgttcatattccaattatcctctttacgtattataatcctgtgttacaattagaaaaagaatactttttcgctttactgcgggaaaacgacatagacggcctgcttgtacccgaccttccattagaggaaagcgcccttttgcaaatgacatgcaaaaaggagaacatcgcttatatctcgctggttgcgccgacaagtgaagaccgtttgaaaataattactgaacaggcctgcggctttgtgtattgtgtatcctctttaggagtgacgggcgtacgcagcgaattcgatccgtctgtatactctttcatccgtaaggtgaaagaattcagctctgttccggtggcggtcggttttggcatttcaaaccgcaaacaggttgacgggatgaatgaaatatctgacggtgtcgttgtcggcagcgcgcttgtcaaaaaagttgaagagcttaaaacaaagcttgtgaatcccggcacaagagctgatgcgcttcttgaatttgaagaatacgcgaagacgttcggacgactgtacagtgtaaaatgaggtgactggatttgcagattaaagaacagctgcggcagctgaaaccgtatcagccgggcaaaccaatagaagaagtgaaaatggaatacgggcttgaaaaagtagtaaaactcgcttctaacgaaaatccgttcggctgttcacaggccgcaaaagatgcgctgcatcaggagattgagcagcttgcgctgtatcccgacggttacagtgccgctttgagaacgcggctcagtgagcatctgcaggtcagtgaatcttcgatcattttcggcaacggctctgatgagctagtgcagattatctgccgttctttattaaatgatcaggcaaacacgattaccgccgccccgactttcccgcaatacagacacaatgcggtgattgaaggcgctgaggtgcgcgaggtgccgctccgcagtgacggcgctcatgatttagaccggatgctggaagcaattgacggcgagacgaaagtcatatgggtatgcaaccccaataatccgacggggacatatacttctgagcaagagttaattgcctttttaaacagagttcccgagcatatactcgttgtacttgatgaagcgtactacgagtatgttacggcggacgattaccctgaaagcatcccgcttttaaagcaatatccgaatgtcatgatcctccgcaccttctctaaagcgtacggacttgccgcgctgcgtgtcggatacggcattgcggacgaagcgctgatccgccagattgaaccggcgagagagccgttcaatacgagcagaatcggtcaggcttcggcactggcagcgcttgacgaccacacatttattcaggaatgcgtcgagaaaaataaagcgggccttaagcagtattatgattttgcggaaactcacggattaacttgttatccttcacaaaccaactttgtgctcattgattttaaccgtccggcggatgaactgttccaagccctgttggaaaaaggatatatcgtccgttcaggacaggcgctcggatttccgacagcgttaaggattacggtcggtacgaaagagcagaatgaggaaattctcacaatcttagctgaaatattataagaggtgatcaagcatcacctctttgctctattaaaatagttgaaaaaggaaatgagtgaaatgaaggatactatattgcttgcggggatcgggctgatcggcggatcgatcgcattggccatcaaaaaggagcatccgcataaacggattatcggtgtggatatttcggaagaacagctcactgccgcgctgaagctcggaattattgacgagcgggccggctcattgacggaaggggcgcagcaagcgtctgttgtcattatcgccacgcctgtcgcccaaacgctgaaaatgctcgatatgctggccgcatcagacatcacccatgaactcctgattacggatgtgggcagcacgaaacagaaagtcgtcagctacgccgacaaagtgcttccggctcattatcaatttgtcggcggccatccgatggcggggtctcataaatccggggccgctgccgccaaagaatttttattcgaaaatgcgttttacattttaacacccggaaaatcaacttctaaagagtcagtaacgcatctgaaggagcttttgaaagcggcaaacgcccactttgtggagatgactcccgaggagcatgacggcgtaacgagcgtcatcagccatttccctcatatcgttgctgcaagcctcgtccatcaggctcatcattctgaagaaaattatccgtttttgaagcgtttcgcagccggcggttttcgggacatcaccagaatcgcctcaagcagtccggcgatgtggagagacatacttcttcataacaaagataaactgcttgaccgcttcaaagaatggaaacgggagattgacacgatcgaatcttatgtagaaaatgaagatgcggacagcctgttcggatattttaaaaaagcgaaagattatcgcgacggcctgccgctccgtcaaaaaggagcgatcccgtccttttatgacctttatgtcgatgttcccgatcatccgggggtcatttcggaaattacggcgatactggcagaagaaaaaatcagtatcaccaacatccgcattatcgaaacaagagaagatattaacggaattctcagaatcagtttccagactgatgatgaccggaagcgcgcggaaacctgcattcaatcccgcgccaaatatgacacattttacgctgactgaggtggaaaacattgaaaagagaaaaagtgacgtctttaaacggtgaaattcatattccgggggataaatccatctcccaccgttctgttatgttcggagcgcttgcggaaggaacgacaacggtaaaaaactttttgcccggagccgattgtctgagcaccattgcctgcttcagaaaaatgggtgtctccattgaacaaaacggaagtgatgtaacgatatacggaaagggcattgacgcactttgtgagcctgacagccttcttgatgtcggaaattccggcacgaccatccgcctgatgctcggcattttagccggacgcccatttcacagtacggtagcgggtgacgaaagtattgcaaagcgcccgatgaagagggtgacggagcctttaaaacagatgggagccgcgattgacggaagagcggacggagggtttacgcctttatccgtaagaggcggacaattgaaaggcatagattacgtctcccctgttgcaagcgcgcagatcaaatctgccgtgctgcttgccggattgcaggctgaagggacgacgaccgtcactgagcctcataaatcaagagaccatacggaacggatgctgaacgcttttggcgccgagcttgcggaaacggagacgagcgcttccgtaacgggcggtcagaagcttcggggagccgatattttcgtgcccggcgatatttcttcagcggcctttttcctcgcggcaggcgctgtcgttcccggaagccggattgtgctgaaaaacgtcggcctgaacccgacacgcacgggaatgattgatgtcttaaagcaaatgggggcttcacttgaagtgattccttcagaagcggacagtgcggagccttacggagacctggttattgaaacctcagctctgaaagcggcagaaatcggcggagaaatcattccccgtttaattgacgagatcccgattatcgcccttttggcaacgcaggctgaaggcacaactgtcattaaagacgctgcggagctgaaggtgaaggaaacgaaccggatcgacaccgtcgtatcagagctccggaaaatcggcgcagacattgaaccgactgaagacggcatgaaaatacacggcaaaaaaacgcttgcgggcggagccgatgtgtcaagccacggcgaccaccgcatcggcatgatgctcggtatcgcttcatgcctgacagaagagccgatcgacatccgtgatacagaggcgatccatgtctcatatccgacattctttgagcatttagatcaattagccaaaaaagcctgaagacgattcttcgggcttttttcttcatgtgtcataaaatcttgggctttgacatagcttgtcttaaacagaaaactaaaagaaagggggaatgcgttttcgttacagaaacagccggaacaaattgcgctgtttgcgtataaagatgccgtccccttttttgccgttttcctcttaaccattttctgataaactataatgccgggtgaagcatcttatttgcgggcaggccctgtctgaattatgataagaataacccgaataaaaacccttttcatttggttgatgaggtataggaaaagaaaggaccggtctgatttgaatacattgattcaagaagccataaaattagttgaagcaggtgaaaccgaaaagggactcaaagcgctttcaaaagctgaaacagagcttcatgacgaagacaaagccattgcagcccagctctactatgaatggggaaacgccgaaaaagcgttagcgctgatcagtgatctgcatgacctctatccgggtgagtctgagctgacgaatttttacgccgaattgttaatagatattgatgaagaagaaaaagctcttgaggtgctggagacgatttctccggaagacccgtcttacgcggaaagcctccttttaatggctgatctgtatcagatgcagggcttatttgaagtaagtgagcaaaagctgttacaggcgaaagcgatgttacaagatgaacctgttattgatttcgctctgggggaattatacttcactcagggatcatatgcaaaagccgttccttactatgaagagacggcaaaagaacggcacgaaatcggcggcgtaaacgttcatcagaggctggctgagtcattgagcgcggcgggtgaatttgaggaagcgatttcatggtatgaaaaagcggcggcagaacatacagaaccgaatacgattttcgggtacgggttcacagcctatcaggcgggaatggtcaaaacagccatcaagcagctgtctgatttaaaagggcttgatccttcctattcatcgctttatatgccgcttgcaaaaagctacgaggcagaaggcatgtatgaagatgcattaaaaaccgctaaagaaggtattacttacgatgaatacaataaagagctttttctctatgcggcgaaaatggcgttaaagctcggcagcgaagaggaaggcaaaaagcttcttcaggaagcgctggcgctcgatccgggttacgtggaagcgctccatacgcttttagccgtctatcataaagaagaaagctttgaagagattattgatctgattcaggaagtccgcggctacggagaagaagatccgaaatacaattggtatttggcgggggcctatacaggcctggagcaatacgctgaagcgaaaaaaagcttcgaagctgcgtatctccattatcaggatgatcgggatttcttatatgaatacgctcacttcttattggaagagggtctccagaaagaagcgctgccgcttttaaaacaagtgctttcaatggatggaacaaacgaagagcttgaagaaacaatcttacggatagaggatgaatttttaagataagcaggattttggaccatgcttgctgaatgtataagtgatgtcagattatacgatcgatagaggagggaattacatgcagacccctgtttctgtcaatgaaaaaaaggattttatccgttggtttttaaatcattatcagcttaaacgccgggagtgcgtctggattttaaattatttaatgagtcatgattcattaatggaaaaagtccattttgtagaacaagccgaattttgcccgagaggcattatcatgtctactcattgcgttgatgaggtgccgtttaggttttacaaagaaaatgtcatgactacggacgcggaaaaatcttttcacgacatccggttaaataaacagcaggatttatttatccagctgaatttccgttcggcctacagctcaccggaatatgccgctgttcttgaatcaaatccgcatctgccgaaagacctgtttgaaaataaacaggatcaggggatggctgaaaaaatattagaacatgccatttccactttccagcgggaaaagctgcttaaagatatcgacgaggcgctggaccgccacgacaaagaaacatttgaaaagctttcccgccaattgaatcagctcacataaatgacagccttgcagaatatgcaaggcttgttgcgtaaagaggaggaacgagacatgagatggagggccgctgatgccgatgcctatttacaatctgcggattacattgataccgctgtcattccgttaatttccataacgtcttcaggaggcttaaaagaggccgttgaacagggggaaagcacccaattgctttctgaagagcttgagcgccaattgaagggacgggtatatttattcccctcttatacatatgttgatatagaccaatcacaaatcgccctgcttcaaaaactcaaagaagaggtgatgaccaacttcaggcacgccttgttcctgacggcagacgaaaaatggaaggattctgaaatagggtctgatgtcatatacatacctgccgttccgtttgaacatatgaaagactctttaaagagaaaaattgcggatgacaagtgcggagaaattttgaacgttttgttacagaagtggaacaattcttaaaaactccaggcatcctgcaaaacacccgttttgcctctgttgaccttgctgaaagattcatatattatgagggtgtcaaatctcagaattattttctattttagttaatttttggtcaatctttagggggggaagagatgggcggaaaacaagatatatcaagaagacaatttttaaactatgcgctcaccggcgtggggggatttatggccgccagtgcgcttatgcctatggtccgttttgcgctggatccggtattaaaaccgacgggagatcaaaaaatggtgcaggttgtcagtgtggatgagctgacgaaggagccgaagcggtttgactttaaaattcatcaagtcgacgcctggtacgaatcggaagaatccaggtcagcctgggtttacaagcatggggatgaaattatagcgctttctccgatctgcaagcatttgggctgcaccgtaaactggaacaatgatcctaaaaatccgaacaaattcttttgtccctgccattacgggctgtatgaaaaagacggcacgaacgttccgggcacgccgccgctcgcgcctcttgaccgttatgagcaaaaagtaaaggacggctttttgtatcttggaaaagcaaagcctaggggggaagggtgacatgctgaataaaatttatgactgggtggatgaacgtctcgatattacgccgatgtggcgggatatcgccgaccatgaagtgccggaacatgtaaatcccgctcaccatttctcggcttttgtctattgtttcggcggtttgacgttttttgtaaccgttatccaagtgctctccgggatgtttttaacgatgtattatgtgccggatataaaaaacgcgtgggaatctgtgtattatttgcagaatgaagtcgctttcgggcagattgtaaggggtatgcaccattggggcgcaagtttagtcatcgtgatgatgtttttacatacgctgcgggttttctttcagggagcttataaaaagcctcgggaattgaactggatcgtcggtgttctgatcttttttgtgatgctcggtctcggatttacagggtatttgcttccgtgggatatgaaggcgctgtttgcgacaaaggtaggtcttcagattgccgaggcgacgccattgatcggagcgcaggtgaaaactcttcttgccggccaccacgatattgtcggcgctcaaacgctgacgagattttttgcgattcacgtattttttctccctgccgctttgtttgcgctcatgggcgcccactttgttatgatccgcaagcagggaatttcaggaccgctttaatacaaatctgatataaaagggaggggatgacatgcaccgggggaaaggaatgaagtttgtaggagattcaaggataccggctgaaaaaaaaccgaatataccgaaagactattcagagtatcctggaaagacagaggcgttttggccgaactttctgctgaaagaatggatggtcggggccgttttcctcgtcgggtttctcgttttaacgattgtgcacgagccgcctttggaacgggtggcggatcctacggatacagggtatattccgctgccggattggtattttctatttttataccagcttttaaaatatgaatatgccgcagggagctacaccgttatcggagcgatgattataccggggcttgccttcgggtcgctgcttttggctccgtttctcgacagggggtctgaaagaaggccgtggaagcgtccggttgctgtcgggatgatgcttttggcgctttgcgctacggtctttttaacgtggcagtcagtcgcgacacatgactgggcaaaggcggaggagcaagggaaaattaaaaaagaagccgccattgatactgaatcagacggttataaggtatttaaagaacaaggctgtatttcctgtcacggggataatcttcaagggggaggcgccggtccgtccctggtcgataacgggctgagcccggaagaaattaaaaaaatcgccgtcaaagggaaagggcagatgccagccggtatttttaaagggaatgacaaacagcttgatcagctggcgaagttcatttctgaaacgacagcgaaataacgtattgtgaagtagacaacagcaggatatactttatgaaaagagctgaccggatgtcagctttttttgcatgatacatactttttacggactgagagttgatggtatgaggtggatttcttatcttttagggttgcgcggcatgcttctgcttgttcttgccgttaattttatcggtacggtgtacggctattattggtatgtgccgcagcttgcggacacgccgttccgatttctgatatttgtgcctgacagcccgacggcgacgtttttcttcctgtttgtgcttctggcatttctcatgggaagaaacgcgccgctgtttgaagcgctggctcttgtaacccttgtaaaatacgggctgtgggcggtcggaatgaatgtctttgtgctggtcaaaatggggcagatgccttgggaagggtatatgctgattgcttcacattttgccatggccgttcaaggcgttttatacagcccgtattttcggttccggttatggcatcttgccgttgctgctgtttggacgcttcataatgacgtcattgattatcttttcggcatgatgccccgctactcaatgctcaatgactatatgcaagagatcggctatgctacattctggctgagcatattttcactcggccttgcatactatttggtgatttctaaaagacggataaagcttgacttacactgatagaatcttggtctaaccttgtcccgctcctcatattctgtaaagagaaggagtgggagggacctctatgaaacgaaagctgacgatctgtcttttacttgctcttatgtgtttcatcacaactgccaaagctgaagatgagggcggtctcaaggaactgaacgacctttcggataccgttttccaaatgacgcggcattcgcagtatgatgaggctctgcaagtgcttggctactttaagaaaaaaatgacacacgtaaactcactgagcggcgccgaagtcaggcaggtgactctgggcttcaatgatttagtgcgcgtcctgaaacaggcagacgcctcagataccgaaaaaatccgggcagccgcccagttcaggttggtaatggatgcgatggaagaccactccgatccgctgtggggttcgcttgaaagaccgattatggcgacattcagcgccttaaaagaagatgtcagcggaaacggaagtggaaatttcaatgaaaagtggaatgaatttatatcattatatgatttaatttatcccagcctgacaatggatgtgtcggccggccagcttgatacggtggcgaaacatatcgaggtgattgagcaggaagggtttcagcagatgacaaaaggaacaaagcttgagcgtctgacactcctgcagcaggatttaaagcgggtttttgacaaggtggagcgggatgacgctgacccttcgctgctctgggtcattctgacaacaggcggtatcattattactgcgctgacatatgtcggctaccgaaaatacagagcggaaaaaaagaaagagaaaaagcgtgagtatcctaagtctaaataaacacaaattgctgtaaaggagctaagtcagtgaaaaaactcatccagcaattggcttcaaaacacctcccgcagccgatcagaggcagaaaaggggcgactgacgaaggaccgcgaaacctcgcgcgtgacttccagaatcctgacatgctcgttccgccttcaacggatgcaggaacggttcaaaacttgaaattctcattttctgatacgcatatgaggcttgaagacggcggatggtccagagaggtgacggtcagggaactgccggtatccaaaaacatcgcggcggtgaacatgaggctgaaaccgggagctgtgcgggagcttcattggcataaagaagccgaatggggatatgtgattaacggaggagtacgtttaactgcggtcgatcaaaatgggcggaattttattgataacgtaagtgaaggggacctgtggtattttccttccggcattcctcattccattcaaggattagagcagggaagtgagtttttgctcgtctttgatgacggctctttttcagaaaacagcaccttttcagtaacggactggtttgcccacaccccgcgcagcgtgctggaggcgaacttcggtgttccgggctatgagctggcttacattcacaagaaagagcgttatatgttccagttggaaccgccgcccccaattgagcgggcagcagtctcttccccggaaggccccgttttagagccgttcagctacaagctttcccggcaggagcctcttgttaccagcgggggaagagtaaagattgtcgattcaaaaacgtttaaggtgtcaaaaacgattgctgcagctcttgtggaggtcgaacccggaggcatgagagaattgcattggcacccgaatacggacgagtggcagtattacctttcaggagaagcgaaaatgacggtgtttgcggcggagggaagagcgcggacatttaactatcaagcgggtgacgtaggatatgttcctgttgcaatgggacattatgttcagaataccggtgacaccgtgcttcgctttctggaaatcttcaaaagcgaccgtttcgaagacgtctccttaaaccaatggctggcactgacgccgcagcgcttcgtcgagcagacgctcaatgtcagtccggcattcgcccgccgattgaaaaagaaaaaatcaccggttgtcaaatggaaacacgaacagtaaaggcggcaaaagccgcctttttattatcgtctgatcggatttttattttcatcaagcgtaaatccttcgccgagcacatcatggacgtcgcttactgcaacaaaggcgtgcgggtcaacggaagtgatgacgcttttcaaaagcacaatttcgtttttcggaacgacgcagtaaagaacgtccctgtcttcttttgtatatgatccctgtccttttaaaacggtgacgccgcgctccatctcttcaatgattttttgctggatcaaatcgtttttcgaagaaataatcgttgccccttttgcggcatagccgccttcctgtataaaatcaatcaatctcgcagcgacaaaaacggctacaagcgtgtacatcgcttccttgtaagaaagatacgtaaacaaagaaagcagaatgacacaggcgtcaaaggcaaacatcgtccggcccatcgggattccgaaaaatttgttgatcagccgagcgatgatatcgaccccgcccgtcgtgccgccgtatttaaaaataatgccgagacccgcgccgataaaaacaccggcgaacaaggcggccagcgctaaatcatgcgacagcggcatatgaatttcgtagcgctgaaaaacactcagaaaaacggaaagagagacggtgccgatcagggtatagacaaacatcgtccggccgagcatacgccagccgatgaaaaagataggaatgtttaataccaggttggaaatagaagggctgatgtggaataacgcatataaaagcagcgtaatgccggtaaatccgccttccgccaaattgttctgcatattaaagtgaaccagtccgaatgaaaaaacagcggcgccgattaaaataaagcaaatgtttttgattctgatttctccaagcattgcatcaaaccccttttccttccataagattgcgtaaatattatagtggatacaaaagaaaacagcaaactgccgtttttaacatttgtcaaatgtacttgaattagctaacatggaagagatgacaggaggtattcgcacagtgagtgacaaaacgatgaaagacttacaagctgaggtcgatgaatatatcggccaattcaaagaaggctatttcagcccgcttgccatgatggcccgtctcacggaagaactgggcgaacttgcaagggaagtcaaccattattatggggaaaagccgaagaaaacgacggaaaatgagaaaagcatggaagaggaaatgggcgatgtgctgttcgttctgatctgcctcgccaactcccttgatatttcattggaggaagctcataaccgcgtcatgcataaatttaatacacgtgataaagaccgctggactagaaaagaagaaggaaagtaggagaaaccatgtcaaatgaaaccattaaagtcgtcattgccggaccgagaggcagaatgggccaggaggccgtaaaacttgccgtccgcacgcctcattttgagcttgtcggcgccattgaccatacatacgatcagcaaacattacgggaagtgatgtcagctgattcagacgctcttatttatacggatatccgcgcatgtttccaagaaacaaaaccggatgtgctgatcgatttgacaacgcctgaaatcggcaaaaaacatacgaaagccgctcttgaacacggcgtccgccccgttgtgggaacgaccggattttctgaagcggatttagaggagcttcaagccttgactgaagaaaaaggaatcggcgccatcatcgctccgaattttgcattgggcgcggtgctgatgatgaagttctcacaaatggccgccaactattttgaagatgtagaaatcattgagcttcatcatgatcaaaagctggatgccccgagcggaacggcgctgaaaacagcggaaatgatttcaagcgtccgtacagaaaagcagcagggccatcctgatgaaaaagaaattctgccgggcgcccgcggtgctgaattaaacggcatccgccttcacagcgtgcgtctgccgggccttatcgcccaccaggaagtcatgttcggcatggacggccagacgctgaaactgcgccatgattcctataaccgggcttcctttatgtcaggagtgaagctgtcagtggagcaagtgatgaaaatcgaccagcttgtatacggactcgaaaatattatcgactgaatcggcaagggggagaacatcaaatgaaaattgctttgattgctcacgataaaaaaaagcaggatatggtccagtttacgaccgcatataaagatatattgagccatcatgagttatacgcgacgggtacgacaggcttaaaaatccaggaagcgaccggattgtccgttgaatgttttcaatccggcccgctcggcggagatcagcaaatcggcgcattgattgcggcaaacgccctggatctcgtcatttttctgcgcgatccgttaactgcgcagcctcacgaaccggatgtctccgcgctgatccggctgtgtgacgtatacgcgatcccgctcgccacaaatatgggaacagcggaaatccttgtccggacgctggacggcggggcatttgatttccgcaatcttgtgcgcggaggagagccgaatgtctgaacacgttgatattctggcgttcggcgcccatagtgatgatgtcgagatcggtatgggcggcacgatcgcaaaatttacggctcaaggaaaaaccgcggtgatatgcgatttgaccgaggccgaactatcatctaacggaacggtagggataagaaaagaagaagcggcagaggcggcacgaattctcggcgtaaaagagagaatccagcttacgcttcccgaccgcgggcttttgaaaagtgaggacggcatccgccggattgtcagtgtcatcagagcctgccggccgaaaaccgttttcatgccttatccgaaagaccgccatcctgaccacggcaatgcggcggctttggtcgaagaagcggtgttctcggcgggaattcataaatacagagatcatcaggaactgccggctcataaggctcagcgcgtatactattatatgatcaacgggtttcaccgtccggactttgtaatcgacataacggaaaccatcgatctgaaaaaagaaagcctgcacgcttatcaaagccagtttattcctacggcgcagtcagtgaacacaccgctgaccaacggttatatcgaaatggtggaagcgcgggaaagactgtatggcaaagaagccgggacggggtatgctgaaggcttcttttcaaaacagcttcccgttttgaatgatgatgtttttgggggcggacaatgagaccattaaaaatagggattacatgctacccgagtgtcggaggctcgggtattattgcgacggaactcggcaagctgcttgcggaaaaagggcaccaggttcatttcatcacatcaagcatcccgttcagattaaatacatatcatccgaatattcattttcatgaggtggaagtcaatcaatacgcggtatttaaacatccgccttatgaccttacactggcgagcaaaatcgccgaggtggccgcgagggaaaatcttgatatcattcacgcgcattatgcgctgccgcatgcggtatgcgcttatctagccaaacagatgctcaagcgtgacatcgggatcgtgacgacgcttcacggtacagacatcaccgttttaggatatgatccgtcattaaaagatttaatccgttttgccatcgaagcgtccgacagagtgacggcggtatcaaccgcgcttgccggagaaacatatgacttaatcaagccggataaaaaaattgagaccatctacaactttattgatgaacgtgtttatcttaagaaaaatacagagagtataaaagagaaacatggtattttgccggatgaaaaggtcgtcatccatgtttcgaacttcagaaaagtaaaacgtgttaaagatgtcatccgcgttttccgtaatatcgcagccaacacaaaggcgaagctcctgcttgtcggtgacgggccggaaaagtgcgtcgcttggcagcttgtcgaaaaatacggactgcaggatcaagtgctgctcctcggaaatcaggacagggtggaagagctgtattccatcagcgatcttaagcttcttctgtctgaaaaagaaagtttcggactcgtcctccttgaggcgatggcctgcggcgtgccgtgcatcggaacaaatatcggcggcatcccggaagtgattaaagatcaagtaagcggttttctggtggaagtcggcgatattcaggcggcatctgaaaaagcgcttgccgttttagaagataaacagctcagcaaacgattgactgatcatgcgctgaaaatggtggagacctccttttcttcgcaaagaatcgtcagtcagtatgaacggatttatgacgaattggcaggaccggagtgatcttatggaacaggaatttgtcaaagccctccccatccttcatcatctgatgaaggcgggccatcaggcgtactttgtcgggggagccgtcagagacagctatatgaaacgaaaaataggtgatgtggacatcgcaaccagcgcttcgccgaatgaggtggagcgcctctttaagcggactgtcgatgtaggaaaagagcacggcaccgtcatcgtcctgtgggaagatgaaacctatgaagtcaccacttttcgtgccgaatcagaatataaggactatcggcgcccggaagctgtgcggttcattacttctttatcagaagacttaaagcggagagacttaacgattaatgcgatggcgatgtctgccgaaggagagctgcttgattatttcggaggcgcacatgatatcggacaaaagctgatccgtacggtgggtaaccctgaagaccgttttcgggaagacgctctgcggatgatgagagccgtccgctttatgagtcagctcggctttctgttagaaaaagaaacaagagaggccgtcataaaagacagggagcttttggcacatgtatcagtagaacgaaagaccgtcgagtttgaaaagctgatgcagggcgctttctcacaagaagcgattcaaacgatggtgcagacaggtctgatacaagagctgcccggcctttccggttatgagcagcaaatgcttgaagcaagcggctttccgttttcttctttagatgcacgcgaagaacgctgggcagcgctgttattgtttctcggtctttgtccgaaaagtgccgaggcgtttttaaaacaatggaaactgccgggaaaggtcataaaaaaagcggtgcagatcataagcgtttatccggcgcagctggaagcagaagcgatgtaccgagcgggagaggcgctgttttcagccgttaaaatcgggatgctgaaacagcataagacgattgatgaacaaaagctgaaagaggttcagagcctgtatgagcagctgccgatcaaaagccttcgagacctcgacatttcaggcgctgatctgatggagctcagaaaccgccgcgcgggtaaatgggtggccgaagaacttcgccggattgaagaagcggtattggcagggaagcttcctaaccgaaaacatgacataaaggagtggctcgcatcatgggatcaacattaagaacccgattaattgatttattttctgaggcgggtgacggctttatctccgggcagaaaataagtgacgcgctcggctgctcgagaaccgccgtttggaaacatatagaggagctccgcaaagagggctatgaggttgaggcggtcagacgaaaagggtacaggctcattaaaaaaccggggaaactcagtgaatccgaaatccgtttcgggctgaaaacagaggttttgggcaaacagcttcattaccgggacgtcctgccgtccacccaaaaaaccgctcatgaacttgccaatgacggcgcgccggaagggaccctcgtagtcgccgataaacaaacggcaggcagaggaagaatggccagagtatggcattcacaggagggaaacgggatttggatgagcctcattctgagacccgacgttcctttgcaaaaaacgccgcagctcaccctgttatccgccgttgcggtcgtacaggccatcgaggcttttacaggcgtacaggccgccattaaatggccgaatgatttaatgattcacggcaaaaaagccgtcgggattttaactgagctgcaggcggaagaggaccgtgtccgttcggttattctcgggatcggcatcaacgtgaaccagcaggaaaccgattttcccggcgagcttcaggacattgcgacgagcctgagcatggaagccggtgaaaaaattgacagagcgggtctgatacaagagattctgctgacttttgaaaaacgctatcaggattacttgaaccacggctttacaccgatcaagctgctatgggaaagctatgcggtcggactggggaacgagctcagagcgagaacgctgcaaggaacgttttacgggaaatcgctcggcattgatgatgagggagttcttcttttggaaacgagagacggtataaagaagatctattctgccgatattgagctcaattaatcttagttggtacaagcctcgtgaatttggtatacttcctatgggcagtatcataatgaactgcacctgatcagcagaacagagattacgaaaagtctgccttgatccaaaaaaggactgggacagagggatgacattcgccgaacgttaaacaagtgggaatccttcttattttacagaaggcttttttgcttgcgaagaattggcggctcatctcctcaccgtttagaggaggagaaacagaatgaaaacaaaactggatttcatgaaaatgaaggaaaacggagagccgatcgtgatgctgaccgcttacgattatccgcaggcaaagcttgcggaacaggcgggagtcgacatgattttagtcggggattcgctcggaatggtcgtgctcggactcgattcaaccgtcggcgtaacggtcagggacatgattcaccatacaaaagcggtaaaacgcggtgcgaaaaatacgtttatcgtaactgacatgccgtttatgtcttaccacctttcaaaagaggatacattgaaaaacgccgcggccattattcaggaaagcggcgcggacgcgttaaagctggaaggcggagacggcgttttcgaatccatccgcgcgctgactctcggcggaattcccgtcgtcagccatttaggcctcacaccgcagtctgtcggcgtattaggcggatataaagtgcagggaaaagatgagcaaagcgcgaaaaagctcattgaagacagtatcaaatgcgagcaggcgggagcgatgatgctcgtgcttgaatgtgtgcctgctgaactgactgctaaaataatagaagaagtatccattcccgtcatcggaatcggagccggttcaaaagcggacggccaagtccttgtctatcatgacgtcgtcggccacggcgtggacagaacaccgaagttcgtgaagcaatacgccaaaatcgacggcacgattgagtcggccctcagcgattatgtccgtgatgtgaaagaacgggttttcccggaagaaaagcattcctttcagataaaccaaactgtgctgcaaggcttatacggaggaaagtaagcgatgaaacaactgacagaaactcaacagctgaaagaattaattgcacaataccgctcagaaggccggacgatcggattcgtcccgacaatgggttttcttcatgaaggacacctgaccctggttgaaaaagcaaacaaagaaaacgatattgtcgtgatgagcatctttgtcaatccgactcaattcggaccgggcgaggattacgaagcatatccgcgagatttaaagcgcgatgcccggcttgcagaacaggcgggagcagatgttttgtttacgccgtctccgagtgacatgtataagggcgagcaaaatgttgccgtgcaagtgaaaaggagaactgacgtgttgtgcggcgtctcccgcgtcggccattttgacggagtggccactgtgctgacgaagtttttcaatctcgttaaaccgacccgcgcctacttcggcctgaaagatgcccagcaggcagcggttgtggacggattgattgaggatttctttatggatatcgaattggttgcagtggacacggtcagagaagaagacggacttgccaaaagctctcgcaacgtctatctgactgagcaggaacgcaaagaagcgccgatgatctataaagcattgcagcaaggtgccgaactggtcagagacggtgaaagaaatccggaaaccgttataaaaaccgtcaccggtatcatcgaaaacacaagcggcgtcattgattatgccgaactgtacgcttatccggagctgactccgcttaaaacattaaacggcaaggtcattctggcctgcgccgtccaattttctaaagccagactgattgataatatcattattgatattgatgaatgggagagatcataatatgtaccgcactatgatggccggaaaactgcaccgcgctaccgtgacggaagccaatttaaactatgtcggcagcatcacgattgatgaagatcttttagatgccgtcggaatgctcgctaatgaaaaagttcagattgtgaataataacaacggagcgagacttgaaacgtatattattcccggtaagcggggagcggcgtcatctgtttaaacggagctgccgcccgtctcgtccaagaaggagataaagtcattattatttcttatcaaatgatgtctgatcaggaagcaaaaagccatcagccgaaggtggccgttctggatgatcagaataaaatcgagcagatgctgggccaggagccggcacacacgattttgtaaaagagccccttcatgggggttttcttttaagatttaggggcaaaagctgtttttccgctccatttctcaacaaaacgtgttacacttttctcgtatgcaagaattgaggtgtccattttaatgaacaaacaacggttcgttgtcatagatgtcgaaacaacaggaaattcgccgaaaaagggcgataaaatcattcaaatcgcagcggttgtcattgaaaatggacaaataactgagcggttttcaaaatatatcaatccgaatcaggccatcccgccgtttattgaacagctgaccggaatttcgtccggaatggttgaaaatgaactgccgtttgaagcggtcgcagaggagatttttcatctgcttgacggcgcgtattttgttgcccacaatattcatttcgacctcggatttgtccggcatgaactgagcgaagcgggctatgagctgccggattgtgaagtgcttgatacggttgagctttcgcgtattgttttcccggggtttgaaggatataagctcggtgagttgtgcgcagagctgaatattgttcatgaccgccctcaccgcgcagacagcgatgcggaggttacgggcctggtctttttagacattttacataaactgaaacatctgcctttaccgacgttaaagcagcttagaaggctttcacagcattttatcagcgatttgacgctgcttttggattcttttattcatgaaagcaggccggcggaagaaaagagctgcattccatacgcctctttttcaattaaagagcccgatcacattccggtttcccgtccggtgaatgcggccattgaccttgaaaagtggaacgaagaaaaagaacagatcttgtccggcatcatccccgctatgaaaagcggaaaggacagcttacgatgatggatgaagtgcttggcgccttccgcaatcgggagcatgcgctgattgaagcggcgcccggcatcggaaaaacgatcggttatctcgttccggctgttttatttgccaaagcggaacaaactcccgtcattatcagcacgtactctactcttttgcagcagcagatcatgtctaaagatcttccgcttttggagcgtatgtttccttggccggtcaaagctgctattttaaaagggaaatcacattatctgtgcctgccgaagtttgaacatattctgcatgaggaagatgacaactatgatgcggttttgacgaaagcgcagcttctcgtctggctgacggagactgaaacgggcgacgccgctgagctgaatcttccatcaggcggcagattgctgtgggagcgcatggcttacgatgagaattcttttatgaaaaaagggaaggactcggctgccgggttttatgaacgggctaaagaaaaagcgcaggccgcagatctgattatcacaaaccatgctttgctgttttcagatcaaagcagtgaaacgaaaaaactgcctgcaagcggaacggtcatcattgatgaagcgcatcatttcgaacgcgccgccagcgagcacctggggaagagagcttcatacatcggactgcacacaaagctcagccgaatcgggaccttaaaggaacacggactgttaaagcggatgagaaaactgttttatacgtatgaactgccggcggaaagtttttttgacgccgatgagtggatgaagcatattcaatcggaaagcgacgcatttttcagttcagtgcattcttttgtcaaacgaagaaaacctaaagacgatctgaaccgtctcgtctatagtctcaatcataaaagccaggataaagggtttcacatgataacggacggagcggagcggctttgtgcgatgcttgatcagctgcttgacatgttttccgtacaggagaaactgttacatcaaaagcttgatcagatgaaaagcggagcggcttttttagcgggcgaatatgtaaagtgtatcagggggctgaaagaatatcgcgatacgttcagcaggctgctgtttgaaaatgatgagaaagaagccgtttgggttgaaattgatgcgaagggcgcaaaaaatgccgtcagcatctatgcgcagcctttggagcccggtgaaatgctggcagaccagtttttcgcccgcaaaaaaagcgttgtgctcacatcagcgaccttaatggtggagcagtcttttcaatttatgattgaaaggctcggacttgcggatttttatccgcgcaccaaaagcatcccgtctcctttttcttacgatgatcagatgaacgtcatcattccgaaagagatgaaatccgttaaatatgacggggagcgggaagtcattgagcatattgccaagtatgcagaaatcatgtcaaagggaaaacagccgaagatccttgtcctgtttacgtctcatgatatgctgaaaaaagtgtatcaggaactgaaactcagtatggagatctcaggcattcagcttctcgcccaaggtatttcaggcgggagtcccggtaaattaatgaaaacctttaaaacggcaagccggtcgattttgctcggaacgaatcatttctgggaaggcgttgattttccgggggatgaattgtcaaccgtcatgatcgcaagacttcctttcagggcgcctgataatccgcttcacgccgcaaaatgcgaatttgccaagaagcaggggaaaaatccgtttcagacgatttccctgcctgaggccgtgttaacgttcagacaggggatcgggcgcctgctccgtacggcgggagacaagggaacgatcgttcttttagatcagcgtgtaaagacggcgggatacggacggctgtttcttgaagcgctcccgacttcatcccttttggagctgacggatgccgaactcggggcttatgtcagccaaacggaataaaagccgcataaacgcggctttcgtggtgtgggatgaggaattgtttttatagtaaaagcgggttcatgccgccttgtgattttattatgccgcgggcgcatcccgttatgactaacaaaatttgttcgaccgatggagggtataaaaatggaaagcaaaattgaaattctgtcaacgattaatgtggagcattcagatgatttatataaaatcgtcgatacattaaaccggactttgaaacgggacaacctgatgttcggccttgcgctcgacgaagaaaatcaaaatgaagcggtcttcaccatttatcgcacataggtgaaaaagatgagaaaaaaagcattaatatttacagccgtatttggtattatttttttagcagttcttttattttcggccagcatttttaaatctgcaatggctcaaaaagaagaaggccacgaaacagctgccgcagccgctaaagaaaaaacgaatctgacagacgctgagaaagtggagacctttgtcggcaaacagaaatattatgttgttaccggaacggataaacatggaaaagatatgtatgtatgggttccggccgacaaaaaagcaaaaattctctcaaaaaaagccagtgacggcatttcaagcggcaaggctgccaagatcgttcgggacgaagggcttgtttccaagctgaatggcgttcacccggcgagagaaaacaatgttccgttatgggaagtgacctatatcaacaaaagcgggcagtatagctttagctatgtggactttacaagcggcaagattctcaaaaacatcacaccgtgagacgtattaggggagttcaagttgaaattggcaaaaagagtatccgcattaacaccgtctgcaacacttgcaattaccgcaaaagcgaaagagctgaaagcggaaggccatgatgtcatcggcctcggagcaggagaaccggattttaatacgcctcagcacattatagatgccgcggtgcgttccatgaatgaaggctatacgaaatatacgccttcaggcggtctgccggccttgaaagacagtatcgcaaaaaaattcaaaaacgatcaggggattgaatataagccgtcagaaatcattgtctgcactggagcgaaacacgctctgtatacattatttcaggtcattctcgatgaagggacgaagtgattataccgactccttactgggtcagctatcctgagcaggtgaaactggcaggggggcgtcccgtctatgcagaagggctggaatccaatcagtttaaaatttcaccggagcagctgaagcaggctatcaccgagaaaacaaaagccctcattatcaattcaccgagcaacccgacaggtgttatgtatacgaaggaagagcttgcggaactcggaaaagtgtgtctggagcatggcattctgatcgtttctgacgagatttatgagaagcttacatacggaggaaaaaaacacgtctcaatcgcacagctttcagatgaattgaaagagcagacgattatcattaacggcgtttcgaaatctcacagcatgacgggctggaggatcggctatgcggcgggttcggagacgattattaaagcgatgacgagccttgcgagccacagcacatccaatccgacgtccatcgctcaatacggcgccattgcggcctataacgggccggctgagccgcttgaagagatgagacaggcatttgaggacagactgaataccatttacgctcagctcagtgagattcccggattcacctgtgtcaaacctgaaggggcgttttacttgttccctaacgccaaagcggccgcagaaaactgcggattcaaagatgtcgatgaatacgtcaaggcgcttctggaagaagaaaaagtcgccatcgtgccgggctcgggtttcggttcaccggacaacgtccgcttatcttacgcaacgtcactcgatcttttagaagaagcggtcaagagaatccgccgctttacggaaaaacacagctgattctgaaaaagcggcttttaaagccgcttttcacttgcattgaccccgttagagtagaacgggtataataaagtgatgaaaaaagagattcaggcagattcctgaatgtctttcttgttctggagggaaagagtttgaaaacaacaatcaaccaagtgtataaacacacaggcgaggaagtaacgattggagcttgggtcgctaataaacgctcaagcggtaaaatcgcatttttacagctgagagacggtaccggcttcattcagggagttgtcgtcaaagctgaagtagaagaagacatcttccaaattgcgaaatcagtgacgcaggaaacgtcactttatgtaaaaggaattgtgaaagaggacgagcgttcaccgcttggctatgagcttgctgttacatccattgaagtcattcacgaagcgactgattatccgattacgcctaaagagcacggtacggaattcttaatggatcacagacatttatggctccgttcgaaacgccagcacgcgattatgaaaatccgtaacgaaatcatccgtgcgacttatgaatttttcaacaaagaaggcttcgtgaaagttgatccgccgattttgacgggaagcgctcccgaaggcacgactgagctgttcgcgacgaaatattttgatgaagacgccttcttgtctcaaagcggccagctgtatatggaagcagctgcaatggcgctcggaaaagtattctctttcggaccgacgttcagagcggaaaaatcgaaaacgaaacgccatctcatcgaattctggatgattgagcctgaaatggcatttgttgaatttgaagaaaaccttgaagttcaggagaattatgttgcatacatcgtacaaagtgtgctggaacattgtaagatcgagctgaacacattaggaagagacacatcgaagcttgaacaaatcaaagcgccattcccgcgcattacgtacgataaagcgattgaattcctgaaagaaaaaggctttgacgatattgagtggggagatgacttcggtgcgccgcatgaaacagcgatcgcagaaagctatgacaaaccggtgtttatcactcattacccgacgtcattaaaaccgttctatatgcagcctgccaaagatcgtgacgatgtcgtgttatgtgccgacttaatcgctccggaaggctacggggaaatcatcggcggttcagaacgcgttcatgatatggatttattggaagaaagattaaaagaacacggtctggattcagatgcttacaaatggtatgctgaactcagacaatacggttctgttccgcactccggcttcggtctcggacttgagcggacagtggcttggatcagcggagcgcctcacgtgcgtgaaacgattccgttcccgagacttctgaaccgtctgtatccgtaatagttatgaaaaacgaagtctcctgcaagggagactttttctaagtaaaggggaaagctcccggagataaccttttacagtaagaggtgtaaggatgaaaaaacagcaatttatagatatgcaggaactcggcatttcaagcattcccaacctgctgctgacacattaccggcagctcgggctgaatgaaaccgaattgatcctgcttttgaagattaaaatgcatttggaaaagggctcttattttccgacgccgtttgaacttcaatcaggcatgtccatctctgctgaagagtgtacaagctgcctgagaatgtttattcaaaaaggttttctgtttattgaagaatgtgaagaccataacggcataaagtttgaaaaatattctctgcagccgttatgggcgaagctgtatgattacatgcagcattctcaaaatgaaacgcaggaaagaacgtcagaaagagaacaaaaaagcctgtataccatctttgaagaagagttcggaagaccgctgtcgccgcttgaatgcgagacgctggccatatggcaggatcaggatcagcatgatgcgattctgattaaacacgccttaaaagaagccgttttatcggggaaactcagttttcgctatattgaccggattttatttgaatggaaaaagaatggcttcaaaacggttgagcaggcgaaggcgcacagccaaaaattccggcgtgttcaaacgaaacagaatgatccgcaaaaagagtatacgaggcaggtacctttttacaattggctggaacaataacatgagaaggggagaaacgtgttaaatttaaagcagattgaatattgtcttgaaaaaatcggcgatatgtttccgcacgcagaatgtgaacttgtccattcaaatcctttcgaattggttgtggcagtcgcattatccgcgcaatgtacggacgctctcgtcaacagagtgacaaaaacgctatttcaaaaatataaacggcctgaagattatcttgccgtatcgctggaagaactccagcaggatattaaatcaatcggtctgtaccgtaataaagccaaaaatattcaaaagctgagcaaaatgatcattgaagagtacggcggagaagtgccgaaagaccgggatgagcttgtgaagctgccgggtgtcggacggaaaacggcaaatgtggtcgtgtctgttgctttcggcgtacctgcgatcgcagtagacactcatgtggagcgggtctctaaacggctcggcatctgccgctggaaggactctgttttggaagtagagaaaacattaatgaaaaaagtgccgaaagaggattggtctgttacgcatcacagattaatatttttcggccggtatcactgtaaagcgcaatctccccgctgtgcggaatgtcctttgcttccgctatgcagagaagggcagaagcgtgacaaaaaagggctggtgaaacggtgacggcgattgacattctggcaggctatgaaacatacctgcgcagccttacggacttggaaagcctcgagatcaaagcggcgctgcgccgccatccgctgtatatggatttcagcggccagccaacagtgcagccatggagggaaaggggcgaatatgtcccgtttctttttcagatttggaatgaaacgaaagaaacgctgcttcccgtttttcaaacaagaaaatcgaggtgtgatcaaaatgacatgctgaagggaatagcctgtctgattgccgcttttcattggacggcaggggagcgggtcacatcactcgactggactgtgcttgaaacaaagcattttcccgcggaaccgatcaattgggcggagcgaatggcgtttattttaacaaaaccgactcaatatcactcgtttattcagctggatgaattgatgacggagatgaagaaacaatatcataaatatgaagccatgaacaaatgttaaaaacctccttttcccataaggaggttttttgtacgaaaaaaatccttcacctgtttggggtgaaggatttcgtccgctaatgagcgggatttgactggatggttgacgaattggactgcccgttgatagttgaagatgagtcttggtttttatccgtttgaccgctgtcaggtttatttgagccgtctgaaccggaatcggaatcattatcagagccgttatcttgctgtccgttgttatcggtcccgttgccgggctgattctgattgttgttatctgtttgatccttatcggattgatcctgatttttatccgggtcatcagttggtgtttgatccgatccgtcagacgtatctgtctgatcgtcatctttgtttgaatcatcggtttgcgtcttgtccttatctttatcttcatcagtcttctgttcatcgtcagtcgctttatctttatccgcatcgtcttcttcatctttcgggactttgaaagatgctgatgccgtatcgctttttccgtcatcgttttccgctgtcacctggaagctgtatgtggagcctggcgtgacatttgagacgacggcttcttttgccgaactgttttgaatgtcactgtagcttccgccgtcaacggattgtttgacattgaatgttgcatcaccgtcataatcccagcttaaggttaatgattttttatctttgtcgtatttcacttgcaatcctgtcggtttatcggctttttctttcgtgtacgttttagaaacggcagttggctgcgttcctttcacgaagtactccgtcacttttttatcatccggcgtattcggtccggctaaagcggcaggattcgagcctttctcaactgtttcttttacaacgctgtcaggctgcttgaagcttcctttaccgtcatcaacgtatgagatcagcttttggaaaatccgttttgcgacttgctggtctgcagaagacagtgatttcttgcctgctttgttgccagactcaactccggtccaaaccgccgctgtatattgaggggtgtatccgacaaaccatgagtctgggactccgcctggagcaatgttatatttttgaatgtcctctttagtaaagttggtcgtacccgttttaccggcgacttccacgttcgccacctgagccagtttacctgttcctgattcgacagctgatttgagcatatctgtaatcataaacgctgtgtagtcgctcatagcacttttcggtttcggtgttaaatcaagcttagtgccgtcattaaattcaatcgatgtgaccgcgtgcggttcgttgtacgttccgttatttccgaacgcactgtaggcgcctgccatggtcatagtagatacaccgcggttaccctcaccaaatccccgatagagtagggttcatatacttgatctttgtttaatcccaatcctaagtcgtttgcgaagtcgacggcatgatcttttcctgctgcttggtatgcttttaaagcaggaatattacgtgagtctgcgagggcctctcgcattgatatctggcctctgtatttattgtcccaatcatgaatcggtgtgccgtcagagtacgtataagctgagtcgtcaatctgttcatacgtcgaccattttttattttcaatgaccggtccgtaatcaagaatcggttttatcgtcgaaccgggctgggttttaccttgtgttgcataattgaatcccccggtagttctgttccgtcctgccccgatggcgcggatttctccgtttgtcgtatcaaggagcgtgacgccgccctgcatgccttcggtaaatccggctgtatcgccgttcatcaattgatcaagataatcttgtgctttcgtatcaagagtcgtgtaaattttcagtccgtcagttgaaatatcgacgtctttcttttcttttgtctcaatttctttcataacttcttcgacaaaagcgctgtatttatttgtgtcctttttatcgtattccttttggctgacgacgccttcatctttcatggacactttcttcgctttttggtattcagagtttgaaatgaatccttgtttttccattaagctgagaacgatgtttcgtcgtttttcggaagccttcgggtttttaaccgggttatatccggtcgggctttgcggcattccggcaagcgttgccgcctgttcaaccgtaagcttgctcaagtcttttacgccgaagaattcttcagccgcttttccgacgccgtaggcgcgcggtgagaaataaattctgtttaaatacatttctaagatttcatctttagaataatggcgctccagctgcagggaaagccacacttcctgtgctttccgtttaatcgttttctgatgggtcaaaagcgagtttttcacaacctgctgggtgattgtgcttcctccctctgaaccgaacccatccgtaaagttggcgaccaaagcgcctccgatacgaatcgggtctataccgtggtgcttataaaaacgggcgtcttcagttgcgataaatgcttctttcacaacatcgggtatatccttaatcgggacgtaggttcgtttttcaccgcccacttccgcgatttcttttccgtttttatcgtaaatcgttgaagagtaaggcgttttcagcttggcttcgtccaaagacggcgcgccggaaaccaaaacggcaaatgccgccgctccgccgactatgccaaggacaaacagaataaccaaggacagcacaatctttttgaataaaccgcctttacgctgtttcttgccttttttcggtgaagagggcttagtgcttttcgtctgccttgccttacggcgttcttcacggctcgtaaattgatctgacataacatctcaacctttcgtttatcaacctttcgctcagtctactgttcctgcgaaaaataaagctgttcaataatactaatataatcaattctcggtgagtatccaagggaaatcggaaaggaagcatcttctaattcgtctttgcgaattgattttctgccgttcttctcctttctctcccaaaagacaaacagcttgtcggcttcgaggaaataaacctttccgaaagcggatataataacaaaacaaatgccgtcttgcctgaccacctgcttcatatgctcaatctgatgatcatgaaaattctgcaggggaaatgccgttttgttttttgtttcttttgcctcgaaatcgatgtagcgtcctttataaatgccgttgtagtcagttgttgaagactgtttaaaataagcttccttaatgactgcggcgcttcttttcggatagtggacgtttacaatctggacgggtgtcggctttttgtgaatgacagcaatttggttagccagataatacttattcgtttcattcaggtcgtcttcgagggtcatgccgcgattactgtatgaatgagaccgtttctggctgttttgggatgaaaccgttttgttcggctgaaaagtttttccattcgggtaccgaatcactttttccatcctccttatcaaactaatagtgacggaagtgaatgaacgtgcataaacgacagaccgtaaccgccattcttcgcctgatcgaaaaagagacgaaaataaaaaatgccgataatatttcccggacgaatgcctataaagcatattatgaccgccatcctgagatcaagtggccgcttttggcatcctttgtgtcccgcaatgcgggctggtcgatgactgatttaagaggcgtcctttatcaggagggccttgacagcagtcagaaaaactggtttttcctttcgtatgaaagggcgaattggctgattttttctgatgcctatcctcagcttctggtctaccagtggtcaaaacaaatcggcgaacctcttttccgtcatcttccttatttccgcgtctcggcttttatgcaggaagaatggttccgcttttggcgtgacggagatacggaacggctcatgtatgctcttattataaatgaacaaaacactatccaagcacctattatacaaaatccttcgtttaaaaagaatgtttttggcacgattcctttttatttaagtgattggtttcactttaatacggtgatattcccttcatttgacggacatttatacggaatttccgtcaaacggttttcaaaaaccgaagagagaattacgctcggaaaacagctggcccgccttctgttcagccctgatcttcacgcttctttttaccgttttcttgataccgttcctcataccggttcacgctttgatatggagaaaatgatcggcatcaaaaaaagaacatcaccgatgcttaggacaacctatcccattgttgcccacccattagacggcgaaagggcggattggtttcaaaaaaggttaagaaaaggggctttcttacaggagaaaatgccgaaacagcttgaactgacggactggtacttccagaaaagacgggagctccatgcgctcttcgcggttaaagagtggctgaagaaatgaaaaagcccgaaaccgttcgctggggtttcgggctgctgatgtgttacgtggaagggcggtttgggccgcctaattttttatcaagcgtatcagtcgtttttgcttcggttttttgctgtttacctgcatttttcggtctcgttttcatacggcacctcctcaactgtatcgtttgcattaacgtgccggttcatacaaagtttgcggcacttttttgtcgaaaggcacgccttttaggataatctctgtttgtttgccgaactgcttctagttttgtcatgtgcagaggagagcggtatgaaaacgagaattatatttgaaagagatgcaagtgataaaagggaggaacatgaatgtctgtttacacgagcaaggctgatattctccgtctgctttctgatatcgaaatccggatttctgctgctgaaaaaacgcttacccaagcagtcagatgctgtcaggcggaagctgaagaaatcagacaggagaaactttcccgtcttgaggaagaggcgcgggagcttcatgtttgtattgatgacctgtttttgactgaccggcgtaaaaaggatttgccgcgagtctgccggataagctgattttgtgcaaaaactttggtaccatatgtactgaggtgagtccgtttgcagacacagtcgttattggagctgacagaacaaatgatagaggcggttctggaagccgaaaaaaggtatcaggatggaaaagagtcaggccgttcatatgatttttttgagacgattaaacccgatgttgaaaaaagagaccggctttgcgcgctttggacagaagcagcgcttgcgtttattcaggaaaaccgtccgaaatacgttcatcatgcacaaattcaggccgttacagaaaatttcggggagctgatgctccaatcatatgttcatcatattcataaaaaaagatacagggatttaactgaatctgttttatatacgcttcgtatattaagggatgaaattgaaaaagaaggcagctgaaaacggctgccttcttttatataaaggggtcgggtatgttattcatacgccgggttttctgctccacttgcttcgagaaccttcatactgtttcgaaattcggttgcggtgagatggccttgaatatagaggaattttgcaaagtccatcagtttatctgcacaatctgtttcatattttttcacttcagcaaaacgctttcttaagtatgatacgttcataatggtgcatcccctctcatgtatgttgagattatgttaacataacgattcgacttttttctgtttttaaaaaattaagactttcgacagcatttgacaaagagcagaatcaccgaaagcacataaccaaggcggaattcatacatatatagcagaaacttagtgagagacaagggggaatgtcatatgcaatggagagcgcagccatatcaaaatatgtaccagcagccggcgggatatttctacccgcagcagatacagccattacagccgccgtatccgcagcagatacagccattgcaacagccgccatatcatcagcaagggcagtacccgcagcaattttatccgaatcaggaatacggtcatatacagcagccgtttgctcctgctcctcctcaggcaggcatgcccgggggccagccggggtttgtgaatccttaccccgttcccagaccgaatcagcagcagtcttcccaattctcaggcatactctcccagtttaaaaaaacgaacggacagtttgactttaataaaatgatggatacaacggggcagatggtaagcgccgtaaatcaggtcggatcgctggtgaaaggcttcaccagtatcttcaaataaaaagcatgaatgatatccatcattcatgcttattttttagggaaaaagaaggtaagcgtctgttcattccaggatgtttccatatcttcttcacttaccttatacgggaggacaacggttcttgtcatgcttgaagacacatgggatgattgagcctgtttatgatcgtagcggattgtaacgtgaaggtagcaccctttcgtttccaccagcatatccccgtcacggaacgtctcgggaacgccgatatcaaccgcgagccccgtcggctcttctctgacgtcaatcgtcacttgcgcttcagtaaaagccgaattgacaaggtgctgaaaaccctgcatcaattctgcgaagggacctgagtgaaaaaattggtccatcgcatggctgatgatgtcctcattactttgcggatcaagtttatcgttttgggattgatccatatgaccaccgcctttttacaaacagactatgcgatgctatgccgtatggttaagaattgaaggaaaaaagaaagtatggttaaatagtggagaataaactggtaacggattcacatttaggaaggggagcacaacacattgctgaaaaaattattcggattgggagacagccggaaaaagccggccgaggaagtgattttttctccggctgacggagcggtgatggatttggcttcagtgccggatcctgtattttcacaaaaaatgatgggggacgggatcgccgtcgagcctgcaaacggagaaattgtttcaccggttgagggagaagtgattcagctgttccatacaaaacacgctgtcggcatccgcaccctttccggagcggaacttttgatacatgtcggtttggataccgtcaatatgaacggcgaaggctttgaagcgcatgtaaaagaaggagacaaagtgaaaacaggcgatctgcttttaacgtgccggctggatttaataaaagaaaaagcaagcagcaccgtcatccctatggtgattatgaatggcgatgccgcagaacctttgcaatttgcaggcgcaaatgaagcgaaaaaaggacaaacagagctttttacgataaaaatgaagtaggcaggggctgattccctgctttttttcttgtgcaggattttcatctagccaggcaaacaaatattcggtaaactgtacctcataaagaggtgtgaacgatgaagaaaaaatcactgagcgaactgattcaggaattaaaaaatcatgaaaatattgtgcattggcatgaagaggaaccgcgggaggcgaaaacgatgccgatgccggagcaagtagatccgaacattcgggcggctctcgaaaagagggggatcgagcggctttttacacatcaatactccgcttttcagacggttcaaaacggagaaagcattgtggccgtcacaccgacggcctccggaaaaacactgtgctataatcttccggttcttcagtctatcgcggaagatgccacaagccgcgcactttatttatttccgacaaaggcgctcgcgcaggatcaaaaaagcgagctgaatgaaatcatagacgagacgggcatggatattaaaagcttcacctatgacggagatacgtctccggctatcaggcagaaagtcagaaaggccgggcatattgtgatcacaaatcccgatatgcttcattcagccattcttccccatcatacaaaatgggtgagtctgtttgaaaacctgaaatatatcgtcattgatgaattacatacgtaccgcggtgtattcggcagccatgtggcgaacgtcatccgccgtttaatgagaatctgcgctttttacggaagcaagccgtcatttatctgtacatccgccacaatcgccaatccgagggagttggcggagcagctgacgggaaaatctgtgcgcctgattgacgacaacggtgccccggcaggaagaaagcactttgctttttacaatcctccgattgtaaataaaccgctgcatattcgaaaaagcgccaccgtggaagtgaacgaacttgccaaaacttttttaaaaaataagatccagacgattgtttttgccagaagccgtgtccgggtcgaaattattttaagccacattcaggagatcgtaaaaaaagaaatcggcgcgaagtctgtcagaggctatcgcggcggatatctaccgaaagaaagaagagaaatagagcgggggttaagagacggcagcattctcggcgttgtcagcacaaacgcactggagctcggcgttgatatcggccagcttcaggtctgcgtgatgacggggtacccgggcagtgtcgcgagcgcatggcagcaggcgggccgggccggacggcggcagggagaggcgcttatcgtgatggtggcgaactctgatccgattgaccaatatattgtgcgccatcctgattatttctttaaacgctcgcctgaatctgcaaggattaatcccgataatctcattatattggtcgaccacctgaaatgcgccgcatatgagctgcctttcagagccgatgaaacattcggagaaaatgatgcgagggacattctcgagtatttagaggaagaaggggtgcttcacgaaaaccgcgaacgctatcactgggcgagcgaatcttttcccgcctccaatatcagtctccgttcggcgtcacaggaaaacgtggtcatcgttgaccggtcagagacggctgatgtaaaaatcatcggagaaatggaccgcttcagcgcgatgacgcttcttcatgatgaagcgatttatcttcatgaaggggtgcagtatcaggttgaaaagcttgattgggaacataaaaaagcgtacgtgcgaaaggtcgatgtcgaatattatacagatgccaatttagcggtgcagctgaaagtgctggacattgacagaacggacagcagaaagaaaacggccttacatttcggcgacgtcaccgtgaacgcacttccgacaatatttaaaaaaattaaaatgacgacatttgaaaatataggatcaggaccgattcatcttcctgaagaagaactgcataccagtgcagtctggcttgaattaaaagaaacggattcggaaatcggcgaaaaaacgcttgaacagctgcttttaggcattgcccacgtcctgcagcatatcgtgcctgtatacgtcatgtgcgatcgaaatgacgtgcatgtcgtgccgcaaatcaaagccgcacatacgggacttccgacaatctttctgtatgatcattatccgggcggaatcggacttgccgatgaagtatataaacgatttgatgaaatcaatgaaggggctgagcgcctgatccgacaatgtccatgtcaagacgggtgtccttcctgcatcggctccgaaatagaaggaatagatgcaaagaaagcgatactccggctcttgaattacgtgtaaaagaaaagggggacgaaagatgtccttgaaaaataaattaaagcggatgaaaaaccacctgaatgtgccggaagctgaaaaaaagccggcagcttcacaactttcggtcccggatattcaagtcccgtttagagaagaatgggaggcattcggagtgaagcctttcttttttgaggatgaatactgtcttatccgcgaaaccgtctatccgctttcgcaccgccacggacggtacagcttcagtgaacttgatgacgtcatggcattatggaataaaggcggtttgacacatactttatcagcagaaggatacgaaaaaagccagctgttcttctttgatactgaaacgaccggcctcggcggcggggcaggcaatatgatctttttgctcggccatgcaagagtgtatgaagaccgtgtcgcggttaaacagcatctgctccctaaaccgggaaacgagacagctctttacaaaagctttttaagtgaggttgacattacgtcccttgttacgtataacggaaaagcctttgactggccgcaggtaaaaaccaggcatacattgctgcgggacaggcttccgaaacttcctgacttcgggcactttgatcttctgcacggggcgagacggctttggaaacataaattagagcgtgtatcgctttcggcggttgaaaatgaagagcttgcttttaaaagggacgaagacacccctggttatttggcgccgatgctgtattttcaatttttaaaggcggaggacccggctcttttaaagggagtgctctcgcataatgaacaagatgtgctttccctcatcgctctttacatccatatgtcaaaaaagatttttgcatcttctgatcagacgtcagaacgtcaggaagcatacgccatggcgaaatggtttatcgctcataaagaaaccgatcgcgccgttttgcagctggaagcgctgcaaggcaaagactttgaagattcggatcgggccctttttgacttagcgatgctttataaaaaacaaaaccgcaggcaagacgccgtgcccctttgggagaaactgacggactctgatcttcacacatgcagacaccaatcagcggttgagctggcgatctattttgagcaccatgcaaaagattacaaaaaagctctgcaggccgcgcagcaggcggcagaagacggggaaatatcggaaaaagaagccgagaagctccatgtgagaattgcccggctcaagaggaaatattcctcttgaaatattgcccgggaaagcgcaaaagccgagctgtttcgccaaaaatatttttttctgaatccgcatcgattttgttgtagaatggtgccgcatcttgtaaaatagcgttagttatttataggggagagttggtatgtataaaggtgttttttacttgttctttgtcgtggtttttttgattgcgtttgtattttcgaattttaaagacagtttgctgacacacttttaaattgggtgattgaattagaacatgcaccctcttttcttcataacctaacagtgtaataaaagttaatggagaggggatttagcatgtttcatcatcattgttgcagaccaaacgtgatgccgccgattgtccatccgactcattgctgtgaacaccattgcttttctaacacggttgtgccgcatattcatccgcaacatacaactaacgtaaatcaccacaactttgagcacgttcattactatccgcacactttttcaaatgttgacccgacaactcaccagcattttcagtgcggaagcccttgctgcgatcattagtattgaacgcttaagcaagatcggttaggatatcagcaaatcaaaatggggcccgatggggagccccattttttaagcaggtgattaattgaaagtattagccgtaacggggtacaagccgtttgagctcggtatctttaaacaggatgaccgggcgcttgtttatataaaaaaggcgatagaaaccagactcagaagctttattgacgaaggcttggaatggattctcatatccggacagctggggactgagctttgggcggcagaaacggcgtacgatctcagagaagagtatccggaattaaaggttgccgttatcacgcctttctacggccaggaggaaaagtggaaggagccgaataaagaaatgtatgaagcggtgcttgctcaggcagattatgaggagagcctgacgcatcggccgtacgaaagtccgctccaattccggcagaaaaacgcgttctttattgaaaagtcagatgcgcttttgcttttatatgatccggaggtggaaggatcgccgaaatatatgctgcagcaggcagaaaaacgccgtgaaacagacggatatccgatttattcgattacgatggatgatctccgtgccgccgttgaggaagaagatttctttacataacacgtcagagaatatttgacaacgggacgtgtttctgaataaaatataacatgatgattcacgatatgaggtgaaaaagatgcttgctgataaagtaaagctttctgcgaaagacattttggaaaaagaatttaaaacaggcgttagaggttacagacaagaagacgttgacaaatttttagatatgattattaaggattatgaaacctttcatcaagaaattgaagaactgcagcaggaaaatctgcagctgaaaaaacagcttgaagaagctagcaaaaaacagccggtgcagtccaatacgaccaactttgatattctgaaaaggctgtccaaccttgagaaacatgtattcggcagcaaactttatgacgaataaggcagatgcacttgtcaaatgagacaagttgctttataatgaacaagtgttcttaacgttcgggtaatcgctgcaggtctttgaatctgtagaggaaagtccatgctcgcacggtgctgagatgcccgtagtgttcgtgcctagcgaagaaataagctagggcagccttgataggctgacggcaggaaaaaagcctacgtctccggatatggctgagtatccttgaaagtgccacagtgacgaagtctcatcagaaatgttgagagtggaacgcggtaaacccctcgagcgagaaacccaaattttggtaggggaaccttcttgaaggaactgaacagatagaaggacagaatactttctgtagatagatgattgccgcctgagtacgaggtgatgagccgattgcagtacgacggaacaaaacatggcttacagaacgttaaacattattgatatgacaaattagagctctcctttaaaggggagcttttatcttgaatgaaacgaaagcttaaaagagacagggtgatacgatgaagaagtacacactaatagcgacggcgccgatgggaattgaagcgatcgtcgccaaagaagtgcgtgatttaggttatgaatgcaaagtagacaacggaaaagtcatttttgaaggagatgcgcttgcgatctgccgcgctaacttatggctgcggacggctgaccgcatcaaagtacaggtcgccgagtttcaggcaaaaacgtttgatgagctgtttgaaaaaacaaaagcgattgactggcgcgcgtacattccagaaaacgcaaagttccccgttatcggaaagtccgtgaaatcagtgcttgccagtgtgcctgactgccagcggatcgtcaaaaaggcgatagcgggaaagctgaaacttcaatcaggaaaacaaaatgaatggattgaagaaacgggacccgagtataaggtggagatttcccttttaaaagataaagccgtacttacactggattcatcaggaacaggccttcacaaacggggatacagggttgatcagggcggagctccgattaaagagacgctcgctgccgcgttaattctgttaaccaactggacgcctgaccgtccgttcgtcgatccgttctgcggttccggcacgatcgccatcgaagccgctttaatcgggcaaaacattgctccgggttttaaccgtgattttgcttcagaagactgggaatggatcggaaaagaactgtgggacaaggcgcgccttgaagtggaagaaaaggcgaactatgatcagccgctgcagatttttgccagtgacgtggatcaccggatggtaaacatcgccaaagaaaacgcagaagaagcgggacttggggacctgatcgaatgcaagcagatgcgagtgcaggattttacgacgaaactcgaattcggcgttatcgtcggaaaccctccgtacggcgaacggctcggcgaaaaaaagcaagtcgagcagatgtataaagaaatgggccgggcatttgaatctcttgatacatggtctgtctacatgttaacgtcaaatgaacaatttgaagaggtctacggaagaaaagcaacaaaaaaacggaagctctttaacggttttatcaaaacggattattatcagtactgggctaaagtgcggccgcagcggaaaaagccgcaacaaagagaagacgcctgatacagcgtcttctccggcatctttacgttttattctgccattaccagcggtgcgcttttgcgttgctccgtaaaataatgttggtctgggacatttcggtgtggccgttcacctgcgatttagagcgtttcggccgcgtccaattgtgatgaaacaattcagaatgctgatctaatcgatctttataactcatgtaaccatcactcccggatagaataattttgtgaagatggatattcgatcgaatatctgttgtagtttgtgcaggtcaggtgcggatcattcaggatggcatgtatagaaagtgaagcatcggcatagaatgatgattatttctatttgagaggtgatcttattttatgctgaacagcgagcacttcagtaaaatacaaaaggcgttagacgcaactgctttccggctggaggaagccggagctaagttcggtccttccgtcatgacacacgcacaggaagaacttgaaaatgcggtaaaacatacacattcaacagaccatccgttcctatgtacacatatcattaaccggaaatgataatgacaaaaacttggcgaggccaagtttttttgttgtattgaaaagggttaaatgatattatagatggtctgaatgccgaatagttaggggttggagttgggtgacaacatcacgtttgccttttgctttaacaaaagaaaagaatttttacgaagaattgaacaattggattggtgacgtgttttacgatatccttcccgagaaaggctttgaccttcgggatgagcaggtatttatggcgtttcagcttgaacgggcatttaaagagaaaaaggtcatgttcgctgaggcaggagtcggtacggggaaaacgctggtgtatctgctgtttgccatcagctatgcaagatatacgggtaaaccggccattatcgcatgcgccgatgaaacgttaattgaacagcttgtcaaaaaagaaggcgacatttccaagctgacagaacatttggatctgcagattgatacacggctgtccaaatcccatgagcagtatctctgtctgaaaaagctggagaaaacgatgcagcgttctgatgatgaaaagtggctggatctttatgagtcgctgccttcattcgtacacgaatcacaagcgatgcagcgcttttatccgtacggcgaccgcaaacagtacgctgatttgacaaatgaagagtgggcaggcgtcagctatgattccttccaagattgtttaacatgtgatatgagacatagatgcggtttaacactttcaagagatcattacagaaaatcaacggatctgattgtttgctcccatgatttctacatggagcatgtatggacggaagaatcacgcaaaagggaagggcagctgccgcttttgccggatcacagcgccgtcgtgtttgatgaaggacatctgctggaattcgccgcgcaaaaagcgttaacgtatcgtgtgaagcagtcgacgcttgagctgtttttagagcgtctgcttcaaaatgacatcagagaggaattcgccgaactgattgaagatgcccttgccgcaaacgatgagtttttctatgtgctgtcagaggaatcgaaggaaatcgccggctctcaccgattggacatccaaaacgaccagcgtgttaagcgtgcggctgacgaactgtgccgtctgctcgataaaatcggcgaggcgctcgtatttgaatcggaaatgtatacgattgataagtacgagctgtcagttgtagaagaatacgtcgaacaaatggcatattcgctgtcgctgtatcaaaaggatgccatcagctggcttgaaacgcgggatacagactcaacgtttgtcgttatgccgagaactgtagccgaagttttgggagaaaaggtcttttctaaaaagataccttatatcttctcatcggccactctttctgagggcggttcatttgattatatcgctgacagtctcggaatccgtgatcctttatcatttaccgttgaatctccgtacgattacgaggagcaaatgtctgttgcgcttcacggtgacatgacgtctgagcagaaaacagtcgaaacgattgaaaccattaaggagaatgaaggacgcaccctcgttcttttcccttcctttgaagacatgaaggaatttaaagaacaggctgccgcgtgggagctgccgtatccgatttactacgaaggtgacgaagagatcagcagtctggtcgaaaaattccagcgggatgaagaatccgtgctttgttccgtccacttatgggaaggtcttgacattcccggtgactcgctccggaatgtgaccatttgggcattgccgtatccgcctcatgatcctgtgtttaccgcaaagcggaacggagcgaaaaaagatccgtttgaggaagttgatctgccgtacatgcttttgagagtccggcagggaatcggccgcctcatccgttctaatcaggacagcggaaccatatccatttatgcgggcggagaaagtgaacgggtcctggccgaagtcaaaaaggtcttgcctgttacaccgaaaatcgtataaaaacaagagctgcaggaatcttatcctgcggctttttttaatccgggaagttgactttataacggcgttccattagcctgtaattgatagtgaaaagggaggggaacggatatggatgtacatacatatgaaaaagagttttttaatctgttaaaaagagtatcccactatgaagaagctattgcgctcatgcattgggacttaagaacgggagccccgaaaaaaggctctgatgaccgggcggaaagcatcggacagctgtcggctgacgtttttcaaatccagacatccgaccggatgaaagagctgatcgacatccttctcgtgcatgcagaagagctctctgaagatacagtgaaagcggcggaacttgcgaaaaaagattatgatcataataaaaaaattcctgaagatgagtataaagaatatgtcattttaacatcgaaagcggaaacggcttgggaggatgcaaaggcggcctctgatttctctatgtttgctccgtaccttgagaagctgattgattttaataagcggtttatttcttactggggctatgaagatcatccatacaacgcattgctcgatattttcgaaccgggtgttacggtaaaggtgctggatcagctgttttctgaattgaaggaagcgatcattccgcttatcaaaaaagtgacggaatccggcaataaaccggacacttcctttataacgaaaacgtttccgaaagaacaacaaagagacctctccttgtatttcttaaaagagttcgggtatgattttgacggcggccgcctggacgagacggtgcatccgtttgcgacgacaatcaaccgcggcgatgtgcgggtgacgaccagatatgacgaaaacgatttccgcacggcgattttcggaacgattcatgaatgcgggcatgcgatctacgagcagaatattgacgaagcgctgagcggaacgaacttatctgacggtgcatccatgggaattcatgaatcccaatcgttattttatgaaaactttatcgccagaaatcaacatttctggaccgcctattatgaaaaaatggttgaggcttcgcctgatcaatttcaagatgtgaaaagagaggactttgtacgcgccgtaaatgaggcgaaaccgacctttatccgaattgaagccgatgagctgacatatccgcttcatattattatccgttatgaaattgaaaaagcgattttcagcaatgaagtgacagtggaagaactgcctgcattgtggaatcaaaaatatcatgattatttaggcattacgccgccatctgacgcaaaaggcattttgcaggacgtacattgggcgggcggcgatttcggctatttcccttcctatgcgctcggatatatgtatgcggcacagctgaagcataccatgcttgaggatctgcctgaatttgatcaattaatagaacggggcgactttgagccgatcaaacaatggctgacagaaaaggttcatcagcacggaagacgcaaaatgccgcttgacatcataaaagatgcaacgggagaagaattaaacgttcaatatctcattgagtatctcgtcggcaaatattcaaatttatatttataaacgaaacgcccggcatacaccgggtgtttttctaaaaattctaaaaagacgaataatcgaaaactaattctttgtaaaagttcggaaatattcaaatttcactatgcaaaagaagtgtatcttgttataatttgattaatatcatacgaacactcatataatcgcgtggatatggcacgcaagtttctaccggtcaccgtaaatgtccgactatgagtgagcaatggaacggctttattcggccgttacgtgtagatcattcggcattgcttgctctttttttggagagcgggcaatgctttttttattttttataagcgggggtaatcattgtggaagcattaaaacgaaaaatagcagaagacggaatcgttctttctgatcaagtgctgaaagtggattcttttttaaaccatcaaattgatccggttctcatgcagcagatcggccgggaatttgcgcggcgttttgaaaaagacgagataaccaaaatcgtcacaattgaatcttcgggcattgcccctgcggtaatggccggccttgaactcggcgttcccgtcatctttgcgagaaaaaggaagtctctcacgttaacggatgatctgctgacggcgtccgtctattctttcacgaaaaaaacagaaagtcagattgcaatctccggaaatcatctctcgaaagaagaccgcgtgttaatcattgacgactttttagcgaacggacaggcggcagaggggcttttgtccatcgtaaaacaagcaggcgcagcggtttgcgggatcggaatcgtcattgaaaagtcatttcagccgggaagagacgagctggtaaaaaaaggattccgggtcgaatcactggcgagaattcaatcgcttgaagacggaaaagtgacatttgtacaggaggtccgttcatgaaaaacggctatgccaaaacactttccctcggtatccagcatgtgcttgccatgtatgccggcgccgtcgtcgttcctttaattgtaggagcggcactgggactgaacgcagaacagctgacatatctcgtatcaattgacatttttatgtgcggggcggctacgctgcttcaagtatggaggaataaatgtttcggcatcggcttgcctgttgtgctcggctgtacgttcaccgcggtagcgccgattatttccatcggtaaggagtacgggatttcagccatttacggaagcattttggcatcgggtctgcttgtcattctgctgtcatttttcttcggcaagctcgtatccttttttccgcctgtcgtaaccggatctgtcgtaagaattattgattgagtacgacataaacctagttatagtagaccttgatattcaaattcttcgtaccatctcccaaatcctcgaccgtatacgttacatgactaatgagcatctttagtattaagtttatttcagagttagacatcccctcagtagactcaatcatctcctgcactttatgatgactccatttttctttttttgtctcagcgctaagagcattttgaaactcagtagatgcaattaattctgctaaatcattttcagctttttgaagtgtctcttgtgaaattttcagcttttctttgtactctgttttactgatgtccccatctaagtacatttcctttatgcgttctattcttccctttgcctttttaacagctttttctcttaaaccaataagctgagttgtataagagtcatcattaacatcttgctcagtaggggagaagagagcttcattgtatttttttatttccttcataattgactggaacaatacttcttcatgaattccttttgtttcttcgcattcttttgttctttcagcagattttcgtaaacactttctaacgtgttttcttctgcctttgggttgttctatagcttgtgctttatgacaataaggacatctaacaataccagaaagcctgtgggtattcatatttaaacgtcttccagccactttatatgttctaagtttttctattctattcaggattagggcatgttcttcatcggttttcatggtttcatgatgaccttttgcaattaatacttcatctagatttttattttgaacaatactgttgttgcttttgcttttcttgtatttaccaaaccatacataacccctatgaaaatcgttggacagaatttctgaaacaacttctccgtaccaaatggaacggccggatggggaagggactttcagttcgtttaacatctcagcaattactgtgcaagaatattcctcttctaagaaccatttaatcatcattctatatatttttttcttttcctcaacaactactgcagctttgagattcttgtcccacttataaccgtatggaacagaccctgaatgcagtctgccttctcttgtggcatttttctttccgttaatcgttcttcgttttattgctctatattcacttcgagcaattattgattcaaactcagaaagcatttcgtcgccttcaattgataaatcataggttttttttggtgtaataaacaatgttccactctgcttaaatgcttcaagtatacgtcctgaatcaatttgtgaccccctagagagcctgtccattgctacagcacaaactgcatcaaactcaccattttcgattcttggcaataataatgagaacattggtcgctcatcaatagtctcacctgaaacaacttcttcaaaccactgaacatttttaaagttctctctttttatgagatattctagctcatttctatgtttggcgagtgtatcttctgaatctctgtcttctctggattttcttgaataaactgctattcttgaattttcgtgtaacgccaagtatttcatcctttcttcttattgtaagtgtagttagattatatcatgtgcattggaatttctttataaaatcctcattttaacgaaacattttagatcagcttgcttattaatctaatttaaagtatcctaattgatgtatcataggggtttaacagccactatagaccacagagtccctcacagagctctgtggtttttatttagatagaatatacccaaataaaaaaagaagcctcagagggcttccgatggattaattcttctcacatgcaaagttgtcattatcgcgatccatcttagatgtataagcagggtgagtgcttggtacgccatgcgggtatttctttctcagctctgtgcagtttgcaaagtgttctgttcctccagcagaaggggaggcttgtgcagagttagaagagctgcttgatgctgaactgcttgaatttgaattgctagggttcgatttatgtgtctcggattggtgtgttgtaactgacttttgaaccggcttagatacacttactgatttcttcggtttcgttgcgcagccattaaatcctttatcagtcgcatatccattcttactccaaatcttcaagtctttatctttcgcagcttgctcatctttcttatacgtgtctaaatacttcgtgtttggctcatatacataagctactcgtgctaatccttctttaagcagtgtttcttgtactgatttgccatctgcgtaaacgtaagccaacattctgccatacttatctgtgcgatctcctttatcaaactccagttgaagcttgccctcgttaactagctgtttatttcttgctgaagcatcctcaccatatggttgtacgcaagagtttggtttcttagtttcaggagtgtcaacaagcaaataacgaactgttttgacttcgcctttatagttaactttaatcgtgtctccatcaaccgttctgttaagtgttacatcgactagctttttcttattgtcagatgtctttttatccgacgaatccttctttgaagcattttcggctttttcattcttgtcattattgcttttgtcgtttgattgagagtctgtctttgtctcttttgtatccttttcttcttgttgcgttgttttagccttatctgaatctgttttatctgtagaagcagaatcagacccacatgcagccaaagaaaagcttagagataatgcgccaatacctaacaaccatttcttcaatgtaattcccccaaatttgtttgttctgtctctatatcggacaaaccttcctaattataaatataaaaccaaagattgtaaatttgattttgtcattttaaaacactcaaataaagttgtgtggtaaaatttagtggtctaaaccttagaggagggaaagttatatggaagaagggaagttaattcaaatgactcttaatggaataaaggaagctgtttctaaatacggaacattccctatgtttcatcatggagggtatgtcatggaagatgctacttttcatttcaaagatcctgctagtcctcaagaaattagcgatatagaacagaagctaggtgttaccttccctaatgactataaagagtttttgttacagcacaatgggatggaaatgtttgatgggattgaaatacttagcttagagggaatcattgaatataatgaggttcaagatttcccagagggatacgttttaattggatatcattttgatggaagatatgtcatagacacaaacaaatcaaaaaatggattaggttatatgctatatctagactcaattgatgatattgaagatgcgattaacttagattcgaattttgaaatatggtttgatatgttagtttcttccaatggaacgaaatattgggaagtgaatccgaatatccgagagtattataaactggtttcagaataaaaagactccgcataggagtcttcatctacgttcatctacaattttacttcttttttgtataagaagcccaccatggatttacttctttcctgtgaaaattcacatcgataggaattaaattgcttgtctgatttcctccaccgtactctctaggtagttgatgatgaatctcaaatttcacccaagtttttttgccgtattttttatcataccatttcctatatgctttgcgttctgtagttccccattttactcttttatcgctaggcacccatttaataaatgcattaggtggagctaatatatttaatcctgattgcttatctgtgtaattggaggggaaaaacattcccttcatattcgttaggtataatccttcagtccaggatatcgttctaacagttggttttttccctgcccaagtagcaattgcgccgccagtatacttccaaaatgttgttttgtttacattaataaattgatgaacttccgatccctttttcacttgaggccctacaaaggtctttctaatagtatgggggcaagtaaactgtttattataataaccacttttgcataaaccctggtgtacttctgctgacgcaggaggaatccctactatttttgaaatttcaactccgtgcatcactttattaacttttccacctaaaaaagtgtgactgaaatagataatactttttgcttttttctcaacagttttccgttggttttcagaggtgacttgtccagatgatgtctgattaccatctttgtcataagctatataagtctgatatgaactttcaacatccattccttgttccttagcaattttttgcaacttactttctgatccagctaattctcttttagaggaatcggtgttttgcggtttttcgtttactgttgagatacgtttgtttaggtcaatgccagttgcattattatcagtgatttctttgtttgccgttgcctttacatcatggaggggatagcaagagaataataaagagagagctattacaactaaccaaatgctttttgacacatacttcataatggtttacactcctttttcttctgtttaaacctgctatgagtatctaagatgtaaataaataatatattttacaattaatacctccttccgcgaggatagtatcaccttttccattttttatcaactgaattaagcctattttaagattttgttaaagttcaaatctcctaagaaagagaccttcgacaaaaggaagaagctctccttacatgtaattttatgtggtaaaatttagataagattgagtgggaaggagacagatatgaaggtatttgaagcatcctcgttaatctcagcagcggaaaagcgagcaaaagaatacgatcagattagagaacaatttatcaatctcagaaaagcatttcaaggaatggctgatttagatgacagcgagttttcaggtaaaggtgctgataacattaaagcattcttccaagatcacgctggtgttacagacagctggcttgatctgatcgatatgaagattgcttttcttaacagtatttcaggaaaagtagctgatgccggattagccgattcgtttgtggaagagtcatttttagagcatgagttgattcatgcgaagaataagtcaaaagccatcatgcaagagcaacggaatgaaatgagggatattcttaatgagataagtgatattgttcatcttgatgttttctctacagaggatgtcgatcaaaagctggattcagcagataagaaacgggacaataccatacacaagctcggaaagctcgatcatgatctaacgaaggaatatgcagaaaccgaagcgaacgagcatttcatccaagccgactttcaacagcttcaaaatgccacgggtaaagggaaaaacgcaacaccacttcactataacgccaaggcgtacagagaaagtgacatacataagaaaaaaggcgagattgcaagacattcggatgcttatttgacgattaaaaaggaagaagcgaaagagcgggaaatcaaggatctgaagaaaaagctcgctgacggtgtgaccgatccggatgaatatttagaaatcgcgaagaagatcggctatgaaaaccttgaaccttcccaacaacaatatgtgatgcagcttgaacaagcaaaacagatggaagaagccggagaagtgacttgggatattttaaaaggagccggcgttggtttatatgatgtcgggaaagacacggtaacaggtttatggcagctgatcagcaagcctgatgaagttgttgaaggtatcataggggcagttgctcatccgattaacacgtataattccatttcaacagctattgaggaatcgtatcaaaaagatatggtaaatggagatgcttactccagatcaagatgggtgacatatgcgataggtacggtagttacctctgtagtaggcacaaagggagccggttctcttacaaaagctgacgtagcaggaaaagtcacctctaaagtcagtaaagcaggccaaaaactgaaagatgtctcaattgctgatttattgccttataatccacgttacgatgttgttccggctggaggagttccttataatgtagttaacggtgagaatttaaaggatcgtctgcttcagttaataaagtccgccaatcctagaacaaggttgcctagaaatcatgggagatgggaagggactcctggtaacggtaaatggcactcagatagacctgacgttaatgcagttactaaaggagaacccgtcacttttatagatggcagaccggtttttacaccatggagcaaagggacgattaagtttaaatcaggagaactgaaaggtactaaaaaggattttccagcagtttataaacgtattcaaaaaatgaaaggctttaaaacccaaaaagaagctgaaaaatggctgaaagaagtagttagattaacaccgcatcatttagacaataacaccatccaattaatccctatggatttacatggtaatatacctcacgtaggttcggcatctgatttaagaggaggattttaatgggtatacaggcaatcaagaaaaaaatgagtgaattttatttagatataagacttgataagaacataaattctcatcaagtccttaaaaagtttgaggacgaaaattctttcgacataacagatgaatataaagagtttctcaatttatacggggaatgctggatagaggaagataatgtgtttttccctgttttagaggacaatccactagcagataacggtaatctccggttgggatatttctacggtcttaataacaatgatgctaatattatcaaattaaaagaggatctttcagaacaaatgccggactggattataccgattgctgatggtgacggaggagatcaaatttgtcttggtgtgaaaggagaagcaacaggaaaagtttatttttgggatcatgaattgacaaatggaataaaagacacatttttggtcgcaaattctttctctgacttcattcaaagtctgtttattgaagagacaacagatgaagacgatggtattttatctattgagctagatgatgatttattaaacagttaagcaaaagtattgcaattgcatgatgtagcagcataagtgtccttaggcaaagtgaaagtggtttaatccataaagcaatagtattgcaaataccatttttatgtggttataattagtgtagatgatacagttatataattattttttgcatttgatttgtggaaatgcataaaataaaaagaccagggtgttggtagcaccccggctctgtacaaaaagctgcccatcaaagggcttgctcagcagttgttcatgataggcctaacccttcaggtttccaggctcaagggaggtctattttttatttatatacgtcaacagggcgattataaacgacccgaatgcaagcattaacattaatgcctgaaatgttgacataagcatcaccccctttcgtaggggatgagcaagactcccttgagtgagcatgctttaatgtacaggaatcattatacactaattccaaatatatgtctgtgattattggagccttattgacaatagacaagttataatgtagtacttttctttttgaaatttgtgttataagatatattaagattttcaacaagagaggaaatttatcatgaagaaagaaattttgctaattcataatggctcaagcattacatatgcagacccacatgaagctgctaggagttatgctaaagctgtcattgatggggtaaatcctaatgaaatagaactatatactgacattgccgtaaatcttaaagaccaagctaaactgatgaaacaatttaaccaggaactatctaagattgtaaatacaagaattcctatgatggaagaaaacacaaaagagctaagcaatgaaatggaaaattcacatcaaatttataagggaatttcaaaagaaagcataaaaagaaaaaggattagaaaaacgaaaataagcaggctataaaaatagcccgtcatttgcgtgatcagaaagaaaagcaatactttgtgccggagtttttaagtgtgaaaataaattactatgtcccccttacaagcatacattgtgatatgtaaggggggatttttcttgcctagataccggagcgctcttcgcaagagagggcctttgccttttcggtatgtgttgcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagtatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcattctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaaaacatcagtcgtgacaaataatattccggtctccattaaagcgattcaaggagaggtgccgcagttttataacggaagcggcggatcaggtgtgacgccttccatccagctgccgaatgaaaaaaaggagaaagacaaataaagacacacagccgcattttcttctggcggctgtttttactttttcctgcggatttcttgaaactgaactcaagtatcgactagagcagcccataaagcttagtggatacttgctgaatagtcatttccaacaattacatcgaactattgttcttatttatattgaataaagaacatttgttctgttaatattagatcaataaaggagtgattcaaaatgcttagagatcgaggggcgatcaaatggacttccatgatgcttccagaacatttaacgcaattaaaacaggacttgttagatgtttcgaaaatggagaagccatctttagatgagcaacaaattgaggagattgacatcctggtttctgaagcaatggcgttgaataaagaactaaagtttaagctctttaaagaaggggttgctgaggatttaatcggtacagttcaatatctcaattacgaacaacacaaattacacgtaaaagatcatcatgatcaaaccgtatacatcaccatgaatgacatcataggagttgcttacaatgattgattactcacagtttccacgtaaaaatatactttgtgtagatatgaaatccttttatgcttcggtttcagctgtaacaatgggattgaatccaatgacatgttatctcgctgtagtcggaaacacggatagacagggaagtgttgtcttagcagcgtctcctgcacttaaaaaagattatggaatcaagactggctcccggttatttgagattccagatgatccaaaaattcatatagtaaacccgcaaatgaaacttttcatcagagtttcaactgaaatcactaaattgttttacaggttcgttcctgaaacatgtgtgcacacgtactcaattgatgaatcttttttagatgcaggaaaagaaaatcctgaagtcatggcagaagcaattcagagcagtatgaagagagagtttggcttagtttgtactgttggtattggtgacaatatgttgctgagtaagttagctcttgatttagagagtaagaaaacaaagactgggattgcacggtggagatatgaagatgttccaaataagctttggtgtgttcatccgttatctgaaatgtggggaataggagggaggatggagaggaatttaaaccggatggggatttcaactgttggtcaattagctaaatatccattagagctacttgaaaaacgattcggcattatgggcaatcagctttattatcatgcacatggaattgacctttctgaaattggagctcctttgatgcaagggcaaataagctacgggaaaagtcagatattacttagagactatacgaagaaagaggatatcaaggcggttctcttggagatttgtgaagaggttgcacgaagagcacgaacacataacaaagtagggcgcacaattagcttgggtattggttacagtaaagatgagttcagcggcggctttcacagagctaaaacgattgatttgcctacaaatatcacaatggatatttatcgatattgcttgatgttgtttgataaattctatacaggcaaaacggtacgaagtgtttcagttaccttatccaatattgaggatgatgtaaatcaacaattaagtctgtttgaaaaagataatgagaagagaagaaagcttggattcgttatggacgggataagaaacaaatacggatctaaagcgatcttacgagctgtttcttatacacctggaggcacagctttgcatagagcaggtttgacgggtggacataaatcatgagaacagagagcagctccctctgttctccttacaaagtcattagttttttacgtttcggctctttcagcaaccttgaacgtatcattttgttgttggagataggaagcacccactgttccggcaacgccgaataatagaactgcacagataaatagtttagttttcatattgcttctccccttttgatttgtcttcttgcttcatttgccaaacgataaaattcaactgcaccccaagcatcctgttttccagtgagaaaatctgctacagagacaccatagctttccatgtcagggtatatacttctttctttgaagaactcgaatgttttcctaactaagtctaaatcatagtccaagaaaagtcctttaaccatttttaacttttcaagtaccatttcattgttatgccgttcagccaactgtttggcctgttcataaaatttttttgcgttttcaatgtcattttgccttccctttaagaaggagataacaaataatgttttagcagcgtaatcatgattttccggctcaatgatttgaagtgacttattaaagtgaaaaaatgctttatcaagttcttccatttgattataacataatccaatattaaacagtgctgaacgcatcaaatgcccacgattcttttcacttttgtttagctctactgcttcctgatacgctttgtatgcttgctttaaagcttcatcaaacttcatactgtccaataaattaccaaatatgacgaattgacagcgtaccttttgtaccccgtatgtagggctcccgtcaatagcaggttgctttttaaatatatcgtaagccctcatggcataattcattgaaaaataagtctgtttcatgtggtaatacacttctgacaatttaaaataaaattcagctttttcaacttcaatatcttcgctctcaattgaatccaaatatctctcagcttgtctatagtgattaagggagaatgccaactccttttgtctaaaatagaacatgcccatgaaaaaataatagtaatattcgagcattccagttaagttttcatggccttcgtatgcttttaactcaccatagtttttctcaatgtcttttatagcgttaggatacatatatgccaacattagcttatgtctaaactcaagtagggagtagtatagtaaaacatcttggttttcttccataatttttatttcctgcataacttctttacgcatttcttctgctctaccgacccaattctttttaatagccacataccaatgattcatctttgttgctactaaatcataaggaatgaccttttcgttctccaagtcctaaacccctttcaaatccattttattatatagttgcattggaggaaagaaatgtaaagggaatttgagtgaaaattaaaaacaaatcaataattcgattatgaacgaaacgaaaaaaataccctcctcgttagagaagggtatatgatcagtttgctgttgcttttagagaagcaagccactcatctaatgttccagtgaagccttgttgaacggctaattcatatgctgattttccatctttaccggcagcaccagtagctcctttagcaccggttgcaccagtatcacctttgtctcccttagcgccagtagctccagtgttgcctttttcaccttttagtgaagctaaccattcctctacagttcctgaaaaaccattgtccactgcgatttcataagcagacttcccagtgacaattgagacattaaccattggattgaaaaaactcatttatgcgcccccaaaaagttatatgtaattcctgactcagaaattttgaagcttgtgataggtgaatcgtgagcgtccatttgaaagccttgtccagcccttaaatagataggatctccaccattgattgatacgtggcatttctgatcattcgaaaagctgaacttatagaaagaatatttaatcgtccaggttgcaggtggggaggggattacttcatggttagattctgacttctcaagcattggacttccgatatatccagatcctatttgcataatcaacaatcattcctttcttcttgaaaatgaaaaaaagggggagataaactccccaagttattttggctctgtgtattccatggcttgatcgctgtctgagatacctgtagtggttggatccactacaaccccattgcagttagaaatgtaagcaaagcattaaatttctcagtaagatcatcgctaaacacagaaatgtcgtatccaaatgcagatgcaattgcttgtgcaaacaaaagagttgcagagaagattgcaaccaggaatgttttctttttaagtcttactttccagttaattttagtcattaaatcgtctccttataaattagctaatttggtgatatcaacaccagcgatctctgcaccaagcagtaagagaataattagaactaaaatctttaatgtcttgccgaatgttccttctaataagttttgaagccattttgtttgcgactgattaacttgctgaaactcatttcttagtccagctatctcagtggtgaacaaattttttgtttcaacaaggtttttttcctgattctcaacaacagtggtaagcctaatgagcgattcacttgttgttttttgtgtttccaacatgatttttctatcttctgcttgttctttaagacgttcttttatatgagcgacctcggtctttaaaacttcatagttttctttttcagccacaatgcaatcatcctccataaaaaataggaggtaatgtcacatcacctcctaaataatcattgatacactttgagctacaatcattctcaaagatatttaaatatatttagatttttgagccaaattgtcctgagatgtagcctcgtttacctttgtagataacttcccagtaacccttagcattgtttaaccctttcactgagccagaaatgctgacggtatcacctagctccacagtgccgagattcttcgctttgtttttatcaggtctgtccattacgatagcagcgctttttactccgacaactttaatcttgcctacagatttgattccactgctatcaggcttagaagtgggtttaggctttggggttgattttccaagctcagcatcacttttaatgtatttcacatttacatatccgctgtatgtagcgcctttggagtttgtatatttgatataaccccaaccattttgagttgatcctttttggtattggacagtggagcctttaggaagggcaagtacaatagaggagttcgcattgcgctgagttctcacattaagactgtctgcgataactgtgttcttaacataagagccatttgttttaacgacttttgttggctttgaagatgaggaagaagttttcccgccgagtgctttcaattcagcagcaatagaagctttaacagcattccaacgtccttcatcaagaactcgatgtgggcaatacttgccagaccagtcttgatgctttttaactcgatctatgccccagccacgttctttaaggagttgtgcaataaacttaatagccaacgcttcagcttttttatagcgctctccgcctgatttagagtagcaaacttctacaccgatggaagtccggtttcctgaattcacacctgatccatcacccgtatgccatgcattacgatttgtaggaatcccttggacaacctctttatcatctacagcaaagtgaaaagaaacttcattattgttaccgatcatataactaacttcattttgcgctggtgcgtcgttgtatgtattgtgaaaagtgatgaatgaagcagataatgcatatggacatttgattgaatatttgtctggtgatactaacatttgtctcgcttgaatagccatattaaacatctctcctaaattaaatttgagcacaaaaaagagagaaggggacaaatccctatctctctttatctcacgtatgctcttgttatctctgtttttgaatgccgtaaattgaataaaatttatattttaactagaacataaccacctcctttaattttaagggttacttaattaagcagatggcaatgccgtaaccgagcttgtctgaatatggagttacaatctccatagccttccaagagtaaaacctgtcttctgattttgtgccgattccataattaccttcaattcgatctcccacagaaacagtactgtccactttcacataaacctgtccaagcaatcctactatattccattcaggacgttcttcacgagggacgtaatctattttttcaatccactcagggtttactttaggcagcttcttaacatcaccggtttctgggttgaccacatcttcatatatgtatccaccaaactcattctttaaatatctaccttgccagtgaatatcagctcctcctagaatagttcctgcagtttcagagattactccgtgtacatcttcaccttttctcgccgggcgaattttagctccttcaagagtgacaattgtccctgtcggaattgcttttccgtcaagactttcaaaatactcagcgtaatcactaaaggtggctccgccattcatctttcctgccgatgttatatccccattcatggagtttagcatccatttaatatttgctctggacggagtagcgccatatccgccaaccaccatatagcgatcattttcaccaagttttacacctccagaagcgtggatttcacgtgatacattttgcccctcgatatgagaatcattggagttgtaaacaccgctacgagatccatctacagagcttccgcctgatgagccgaaaacgttggttcttgttccctttgcaacgcatcctccggtagtagctccaactaaagtggcatctccaagtgcttgaggttcacccgatgaagctaatactgcactagtatttgttttagcatagccagaagtcgtagccccacgtagaccgcccttgaaattattcgggataaacgtgtaggtttttccggcaattttactgggagtagcgtattgttcacacatcgcagcgctaatattagcttgtgaattcgtgcagtaaacacctatcgaacctgctttgtttgatcccgtcatgttaacgttattgatattgactgagccaactttacttcccacagcaataccaactaaagcagattggttaatggttacattcgagatgtttacattatctgatttttgagctccaccgattacatagatatcgttactcgctgttgtaaatcccgaaacagtgatgttgcttaggttgatatttttgcttttatattgggtggtgatgattgcagtgtttttataatcataggttggatcaccaattgcgttgaagttcgaaacgttgacatttctataagcggaaatgactagtgcgcgaggatttaaaccttgataaaggtcactgaaaataggatgttgtgcagtgcagttaacgacattaatgtcaaatgcacttgtggagattttttcggaggctaggtggaagccaatatgtctaaagtcgaaagcgcggatatcattttcggaatagcagtttattaagtttacgtttcttgctgcaggtgctctattgtgagctttgacttcaaaacccctgcaattttttcggctgtaacagttcacaagccatacgtttttagagccatcatcaatttcaaaaccgtttgaatttgaagctcctttgctgtgtgcggatccattagcgtcataggcgtaacagttagtgaagaagatgtagtctgaatagtgagttgtgaagccatcatcaccatagttagttgcagtacaattttcaatccaaacatatttgctaccatttggctgataatgatctgctccatcagaagaagagttccaaacaggggagcttacatcaaaaccgtgtacacctggattacgagcattgacgtttctaacccgaacaaatttagagttaacaatccccacacagtttgcatttgttccatttgtaatggtgttgtcctttttgtctaaattccaatcgaggtctaagtcttcaattaagatatattcgtttccgtttgtgtagtcgctattggttaacacacaagatgttccggtagcagttgggtgaagcttgataatagatcctgatccaacaccgtaaagtctgacataagaagggatatgtaatccttgaaccatataaatacctgcgggtacaaaaacttctcgcttcccgctggcaaaggcagctttgaaagcttcagtgtcatcagtaacaccatcacccttagctccaaaatcctgaacattgacacttcgtctgataaactcatttaagactttatcaacaattgttgcaccagctgcagggatttttgaaatgtctccaatagtgtttgtgatatctgttaaaccagaatcgactgtgcttattacgtttttaatatccttagaagctttatcaaaagcctcttgaatatcgtctgcagtatatctaatattatttgattttaaccctatggcatcaatgggtatccattgctctgtttcttcgtccttatagcccattgtgtttacgggaattaaattgtcgctcaatatatactcctccttatccttttctaatccaaaccatgcttccgtcagggggttctacagatggttttatcctcatctttttgggagcattgttcgttctcaaccatactgatctgatgttgtaaggctctacatagctagaaacaatgttgaaaccatcatacttatctgacacgctaatatttatccagtcgaaaccatcccatcgatattcaatgcctgtttcttttacagtgacagtccaaccaatttgaggggaaggataagtgttcaataaatcctgataggtgtacacaaacggcaagtaaatcttcctagtattctcaactacatactcataatctgatgttgcttgtctgcaccaatttgttatttcaatacagcgcttggtgacacgttcacattcagcaatacgttcattgatacgaataatggcatcttcagcatcatcaattaagccttgaagcgtttcaatgaccatatttccttgtcgtttaatccaaattcttgaggcagggaagaaggatgcgccttctccttgatatgcaaaagtaagtgatttgccttcatttgaaccattgaaaaagacaactcccataaggtaatcaaccttaaagtagttgtcttctaattcaccatcttcaatttctcgccattctttactgtcaccactaacctcgactctgtactcacggttaggtacttctgtaagtaagactcgaccattgtaaacagttaaagtttcactatagcttaaataagggtcatcgattgaacccttccttttttgagaaagggtagggtcgttatagagctgaggaaaatccaaactaaattcaccgtcctttcttattgtgtaattgatttgagcaattcttctaagtgcgcgactctctcttctaaactctgcagtctgcccttagtaccacctaatgtttgtcctctaataatggattcagctttcttgtcaattacgttgtaaacagacttctcatctgaaattgcatatacagaatatccttgccaccaatcttgagcttgaaaaactctaacccatgcttcaaaccaattcgcctgaattgattcattgtattcccctaggtcaccgaatgcgttatggggctgttcaggagagttactgtaaggtgggatgccaagttcaccaaagaagatcggcttattccatttatcataaaatgctttgatttccttgaatatattttgtccgcgtccgtataacggtacgctataaatagcatcaattagctgatcgacagatggatttcgattatcagttaattcaaagtaagccgctattgcaataatatcgactagtccgaatagaggattattcagctttttgttgtaggcagcaatcgtttcgggagcccaatcagcggttacccaataatttgttcggtagagcatctttccactgaataaactcctaacgcttgtaataactgatttccacttttctgttgagtcttccatatgaactaggtttgaagcaatgtataaaccgtctaatttaaattgttcgcattttttagcgaagtcttgcaggatgttgttccatgctacgaaccattggtctagatcagaaggtgcccaatcggtttcagctatcgttccatttgcgatgaaggggtagggttctaaaataatgttgtacccgtcatttttgagtttagggatcatatcccacgcttcgttataagtgtaatccacaacagttggatttgagtctgaagcatccacagcattaataaggataggaatagtgattgtatttaagtttaaaacagttgagtcataactaacatcagcataatatttacgaccaaatgcagaaacatttccgcctttccatttcaggggattgaccaaaaggttattgagctcaatgttttggacacgactatcatagtcggagagtttagtgtcaacttgtgctgctgtggtttcaactaactcagcagttttctggtcactggaaacccatttttcgccgtcataagaggaaacaacaccggtaaccgtattagtccataaatcgtttgcttctggctcttcgggttcagttgaggagacagtgtatttcgagccattaagcttacctttgacttctacagtagaagaggggaggtaggggttttctgaggggaatttaggctgtacaatatcagatagtattcgaccactgctatcaatggacgtctctactgtgcgataggcttggactccaaatgtatagtgtttatttgaaacttgaccggttaatgttgcaattcgtttatcataactaactgataaatattgttcagctgacatctttgcaccaaaaagataggtatcatctgatgtgtcagagtagcaatggataagaaaaccatcgatattgtatttatcctcatcggagtctggaaaatcccattcaattgatacatctacagatccattatcatttacaacatgagttatagcagtcccgtcatttcggatagttgggtttgctacgggtgcagatatacgatcatttcgtgcattgtaattggtcagtagggtatcataatcaatctttttcttattgaattcagttgatgctttcttagcagtatacaatgagcgtgcaaagtcttgttctatcgtagtagctctttttccattcgagagtgttacttgtatactttgctgctcaaaatcaaaattcattcctgtaagtgttgctttgacatcagttctaaaatcgtcattaactaatctgattatatctcccaggtaaattctatcccaaaaatccttttctttgttgacagtgaataagttgacaatgtttgttctgatgtctaccggaggtgtatttttctccccaagttcctcaaggcctttttcatacagctctgtttcatcaaaaatgttgtcattagaccaatcatcttgacggataaaataagacaactttttcattagcttttcaccgagaaacttatccatagataaccgatcttttaacactgctatttcttcagttatcttggaaatctgattggcagtggtggatatttcagctttctttgatgtaacttcaagttgtttggcatctctttgcttgataaggtctttcgtgtcatctccagctttttttgctactgtgatcttatctaagatttgttgtaattcaattttttctagggtgaagagggtattctcctgtgttgtttttgttgcttccagatcttttttctgatttaaaaggaggtaaaaagaagagccttctttatttacaagttcattgtaatctaaaattgcatggcacaaatcatcatccatgtaatcactatgcttaattacatttctcttttcatcacgttcaaaagggtagaggaaataagagaaatcatccaagtaactttgtccagtaggattgactgaattaataacaattccatctttaccggtaatgtctaatcgtgttacaacttcatcaatatcaatggtatcttccatatcaatcatgaaccttttaggagagaattggacacctttatacttggacacagtttcttttttataaaatgatactgtgttgttcacagtatcaaatataggcacagcctcaaaagtttctccaatgttctttaaaaactcatatcgggtagaggtaacatcaaatgagcggcgtttttcattaaaagaggggtcaataaagtctacagtaaagcaagttcctttaagacaatctgtggcaacttccaacagatttttagagatgccttcatatgatttgattttgcttttatgaagaatgtagggaagtccttgagctctaacttgtattgtttgttcctcattttctgactttgtcaatccggttattacaaaccattcaactctgtttaagaactctgccttaatgagataccagccttttatgagttctgccacatggtttggcttcatcttgaaattatatcttgctttaagtgggatattaaaagttagatcgtggagttcatcaaaattcaaatttagagaggcgttagagaaatctactatattagcgattttctttttatttggttttgctaaagaaaccttgagatggcctggtttaaaatcgtaaatcaataaaacatccccttacaaatacttatatctgtatataaaccggatacaacattcgcccgttattttaactctgtttatcccccttgttaaaaaaacatactgttcattgacttgatcataacactcatacccagtaacactggaggtgatcagctctttattggcatctacattaataacttcttgatgtttaattgatgtgaattttagaggttctttataagctgtcaagttttcgactgtgatgtctccatcaccgatttttttgaattcaagagagagtgggatatctaaatcccctatatttttaatttctatattattagaacctgatgatatgtcataccaatgggtagttgtttctcgtccatacctataaggaaatactttcattgtcagcttcacatatccgtcattagagcagttgtgtaccaaatctgttgcattcactggcaaagcaaaataaatgatatctaaattactactgaatgaaagaggcttataatcatctacatttagccaacgtgcaactcttcgaatattttcttcatctaaatgatcttctatgtaaaagtttaaagggatttcatatggttcacgtttaacactgtctacatacggttcagaagctgatcgtgtatatgtttcatttactgttctattcgctacgaaggtctcttccaatagtccgccctctgtgtttacattcactgccccaatttcataagaggggatatcatcgaacatgaaatattgactttctctaatcataaaattccacccttaccaatcaaaaagcaagctgaagagcctgcattatacagactcttacatgcttccatttaattttataacttctttcttgatggtttcgagcattgttctggctccagtttccccaccagtaagtttatcaacattgaaaattattggtgtgttaattgttttatcaccattagaattaacggttgtggtagggggcaggttagcagtcttaacatttggtatcaaactattagataggctcgcttggttaatattcggaattattgatggaatagaagtaatccctttgttaatcaaagctgctaattttccaccttgcccccatttaggtgtttcattattcagatcgttatcagacagattgcgaacatactttacagtttcaagcatgttcttggtgtcagtcttattcagaataagctctttatcatgaagaatagcaagcttgccagcacctaaacctgttcctgtgtatcctcctgtttcaaatgaagatatttttttgcctgttgtattgcctttggtcacagtattaagggcattagaagcttctttaagcttatcgataaggttattagagatacttttaccaatggactccatattgctgttaatgaatttagagaattcattcagttgcttagcaatatcagtaatcttcccatccattagctttttctcaagttccttaaatccacgctcatcattgacgagatcatcatatttcttgttaattgaatcttcgtctttttgaagctgatcttgcaacgcttctttacgtttgctactttcacgatctttaagaaactcatctaaatctaactgttccttttgtaactgctcagttaattccttaacctttgacttaccaaattctgagtcatcaagagaatactgattaatttggtcagtgagtttttggatactctcttgcttctcttttaactgtctttgaaatttagcttcatcgtcagttttatcgatctcatcaatcaagtcttgtgttgctttttggtgcgcttttaattcaatatcacgcatcttttcgtacatctctttatagatggagacaacttcatcagcaagggatttgtacacatctttgattgatttctttgtgttgtaaagctccagattgtaatccttctgcttgtctttccagttctcgatttcttcagtaatttgtttctgaatatccgggaaccctttagcagctttcttttgtgcttccaactgttttatatacttcttcgcttcattctgttgctgctgaataagcttaatctgttggctataatatttaaccttgtctttatcttcctcggtcatggatattttgttgctaacatctttaagcttggattcagttttcttggttgatttctctataccgttaagcgtttcatcaactttggattggatgagctgtccctgaagttctcttacttcttcttggaaattgatgagatcaatcttagcttgttttaattcctcagcaagctgtgctctttgagcggcattcagagttttgtttgttttgatttctttttcaataaaagaaaccttctgactctgaatcttttgctgttcagttaaagcttttttctgatcgtttgtatacttacggaactctttactatcgctcagataatgactagcgagggctttgtctttagcgattcttacatcaaaatcaccaatgcgcttgtcatattcatcaagatgcgactgaacgatctcatattgaagctcttgtatctgatcgtttactgaattaatgtcaccttgaagggagaggaggtcggatttagcttgcgctattgcttgttgtcgttctgcttcagcttgagacgcatctgaaatagatgtaccgacaccttttaaatacttctcagggtcaattgtctttccgttttcctcaatttgaagatgaaggtgatttccagttgaattacccgtactgccaactttaccgatggtctggccagctttaacagtttgaccggctttaacagaaggggtatcaagcatatgcatatacttagcaacttttccatcatcctgctgaatgacaacccagttaccggcagttttactataaccagcaatttggactttaccactttgcaaagacttaattgcagtaccggcttttgcggcaaagtctgtccctttatgtggagttgatcggtaagcgccatcttgagcaccatacttagaacttattctaaacgcgctgttcttcgtgtagtagcttgcaatggaggaattggcagaagtcattgacttcgtgtaatttgacatgatcttctgaacataattctgtgtttctttgaagggagggacgccgccatatttaattacattaccaggccctgcgttataagcagcaagtgctttctcaacattgccaccaaatttgcttagttgttgggctagatatttcgtgccacccataatgctctgataaggatcataaacattgtttacgcctaagcttttagcagtggaaggcatcaactgcatcaaaccagcagctccggctccagagcgagctcttgcattgaatcctgattcttgttggattacagctgcaattagagctggatcaacaccgtatttgcttgcggcagaattaatgtagctggagtatttaccggagtaagacccaccaccagaagaaaaagaaccaccagaagatgaaccagaggaaagggaagaggtaactataccgtattgtgcaatgttccctgacttaatttgatccttgaggagtttggcttgctcctgcataagctttttcttttgttgaagagctttaatttctttctgcagggcatttcgataactttgggaatactttggatagtcgtttacttgcttattgtacttttcgatttcagcattaactttctccagagcttccttgtatttatcagccacgtacatggacgttttggtttcttcatttgctttctcttgctcgtctgtccatttttcaagggaagtacctgattctattaacgcttgtttgtttgtttcctgagtagatgtagcttcttcagatgctgagatgtaggatttaagagcagctctaacgctatccattgcagagatttggctgttagaaaatccaccaggttgcaacattttttcttcaatcttatgtaattctttcttcgcatcagctacattattgattgatttaacttcgagctgagacaattctgcctcggatatatcgagcttacgctctctccgaagctttctaaggctgtcaattcgtaaagaatcagcgtttaaggttttaatggcattattgacttcagttttcattagcttattgctatattgaaccatgtcattataggcatcgagcttaacttttcgctgacgaattacttcatctcggttaacctttataacaccattttcataacttattgctttggctaattctttatctttttggattagagcattagcttcattggcagaaatgctctttccttcagccatcttttctaaaagttcgtttaaaggagcaacttgttctttggtgttattaaaaatatccccgttaagaatgccttgaacagagtcaaactgcattgactctgacatgcctttgattacatctttaatctgactgatatcatttgcgtcaagcgcttctttgagcttttgaccaaaatcttcagcttcattacctgcttcagcaagagtttcccctaaatcaccaacttccgatttaacagaagaaatggccttatctccatctttaatgttcttttgtgccttatcaaaactcaacttaaagacatcaatagaagaactggattttgaataggtctccaaaagggtttgcagatcctttttcgcgctatcaaatgctttttcatcgtttgaattcaatgccgattgcattttctcttggagtttacccaatgcagaagagaatttatcgagatcatcaggattcaaatcatcttttaaagtgagtttacctacaatgtcattgatactcgtttttaaagtattgctgatatctatagaactgtatgcttgggcgattgagagaacactgtctctaacctttgcatttccacttgctatgtcagattgtgctttaagcataccttgcttcgctttatctgcagcgattttataatcttcatcatcagcaaggaagtcccattttggtctgcctttatcattataatcagcaatttgtttgtattgcttcaactcatctttagactttttaatttctttagaagcgtcctcgaaagttttcttggcgctgtctttagtttccgtctttttaagttcaaggtattctttagtgttctcaatagcttcttctaaagctttattactttttaaaattgcatttccttgagagtcataaccttgaattaaagcggggaatgtctgagccaattgctgagtaacttgaagatattcttgctcttcatctgatgaaagggttcttgaatctttggctttttgaagctctttatactgttttattagtttgtctgtggagtctttgttggttgtaattgcttcaacattggtctgttgactctgttcaaaatcatctttagctttttttgcatctgcgaaagatgaaactatgctttctaaagcccaacccaacgcagcaagcgcgcctccaaccactgtagaaactaaaagccctctaagagcagttttcaaaacccttgatgcaacagcagcacgggtcatacctgcttctaatccgatgctagctaaggtttcttgtctcattgcttttgagcctaatataagagttgtagctaaagttcgagtgtttttactgagtaacaatgtagcagtgctaatcgtcacaaaaagagggggaggaaaccaacagtgttaattattccagtggaggcttttaacaaagaacccagagcttgagtgaactcaatcaatccgtcactaataaaggcatccgatgaagctatagccaattcagtgaaattgttttgaagtttatttaaccttgcttgtaagctatctgcgtatttctgctgttcgctccaagcgctacctgcagaattagaagctgttgcggcggcattttgggcgatagagaagttgttcattaaggcattaaatcgagacaattgatggatatttgcaacgccaatagaggtgttttgtctttgagcatcagttaatgtgttccatttggctgctacctcattaatcaactcactcgcagattttgcttctccgcctgcagtctttacagaaattccgatttcatccaacgctttgattgcgcttcggttgttacctatccgggcaaaaatagttttaagtgagttaccaacaacgtttcctgattcacgagtggtacttgcgattgctgtagtataaccaatcagatcgtttaattcaacaccgaaagtcgaagcggtgcttcctgcttttcgaatagagttggccagatcaagagtagttacagcgtagttgttatccacttcatttagcttgtctgcaattgaaatagaatcattggctgcaatattgaagtttaacattgcggcagttaaagtattaactgtgtcatcaggagttaagtcagagacgttttgtagaacctgcgcggtttttgttagagttgacaattcactttcatcgaagcccatacgcccgaaatcaccggtcatttggagaatgtcagtgattttgtttgaaagtgtgtcacctaaatcgattgactcttgaagaagttcattgtacttgtaatcaggctcattcatcacacgtctgatgtttgtcattagagtatcaatttcaacagcctgagataccatttccttgagtccagatatagcgccgtagaacaaagaaccagagattaaatatgtagacatacttttgaaagcttgcgttagctccgcaccaaaagacgaggcttgactagctgctgcttgcgcatttgaagccaattccctgtattgcatgttcaagctttgcatttgagctctgatattgcttccgccggcacttacattaaggctattaactgcattgaggtactcttggatagcttgtctatttccagcgcccatcgtatcgccataacgcgtattaaggttttgtacgtttacctgtgcttggcgttgataaagctcaatagtttttcggagttcattatttttagccacagcagcagacttatcatcgagcattttaattctgttttgtaatgcttcaatttgttgagctgtttgagcagtgtttaatttccgcccaagggaagagagggtggtgtcagttacaattccttgctgtctaagtttttctaaatctatctttagttgttcaattgcttttcgttgctgatcgtaatttgttgtaacttttgatgacgtagcatttgtctttggatcagtcgtatatgttatatcatcgaagccattgcggttcttttgagttaccctcgtcgtttgtccttgagaattcttctgttctgttcttttctgtacctgacctagtttttcagtcgcttgagcaagcctgttaacttcttgggtttgttcacgtagtgattgattacgattgtcgatgaatttcttttcacgctgaatgatttcgccatttttcttatattgctgcgtcagcttttcaacagtgccatcggcatttctggtaaccgttgtggtttctttaattgtttgattgaaggatttgagatgtttttggtaagtgtcaactgcagaggagaattcgttgagagtctttaaagcagaggcatcaatattggtctttaaattaagggaattaagctttttctctaaagatttaatttgctgatttaactgttcgacagtctttgaggaggtatcagcttttggggtcagtattatttttaaatcttgactcaaaaataagtcacatcctttcaagtggggctaatcagagcaaataaaaaagccactcaaattattgagcgactgtacttgttttcttgataattacatccatgacaccttgccaatactcagcgttttttaaagcttgctgtatgatattcccatcttttttataaccttgaggctcatatccatcatcctcgcgagaagggaggaagtggatatagtgtataggatttttgaggttttcgactgtaattttaagcgtaattgacttcaccatttctgtttgagtagaggaggctgacaaaccaccaattgttgcaccaattccgccgcctaataatcctccagcaataatccccgatttggcaaccttcgaaatcacctggtcatccagtgagatttcagattgaataatttgggcaaaagggacaacatactcgtttatttcttctccatttagctgatataccttaaggatagatttatcttcattgtaagcaattttagttttataagtgctaaagaaattatcagggttaaattcgctatcataggtctttagtgtttcagcattttttctaatcttttcagcaacagttgcattttttattctgtaaggttcgagcgctaaataagccaaaccgccaattatcagaaaaacccccaaaggtctccagccatccattaaacagaagaaaaggctgaataaaaaatagccaccataagccataatcttatagcccatccaaccaccaccagtattattttcctacattatatcatgatttccaaaagtgtagaactagcaaaggggagggtcactttcctttttcggacttaatctgctcaagtaattctttaaaatatgtagcagtaataacaatgtccctatcctttcgtacaacaaaaagtaggagaaggcaaatcgatgttgcgattagaatataccaaagcaaattaaaactaaacataattctgagagatagtaaacatgttcctatgagcacacttccaactgtccacattttcgtatgatcgaaggacgcttcaattcgactcatacgggaaatagctaaaattaaatctgatgaattgagcgattttaggatttgaaatttgcgcttttgttctgtgtagagctcaccagagtgcgggaattctttttgtatgtatttgatcaggtcgcgactattcatctgtactaaattgtgtttaagtattgtcttattcatatttttcacctctccatattatcgtcaaatatggaaataagtttaaggttttatccataagcaaaacccttcggtagaaggatcttgattctgcataaaagagggatttcatttacacttcaaattttgctttcttgtcttgaatagcatctttgtttacttctagatagtgattctttgttacgtcagtgcctttatggttcaataattgagacacgtcctctagactcatgccactgtgatacagaaggttactaccactgtgccttaaatcatgacagtgtaattcaggaatatcaattatttctccgattctctttatccaatatccttgtaaagttccggtttcagctttcttccatatgcctccgtactttgttatgaaaaggtattcgcattcaattccgttttcggatctgtactccagccattccttaacaagatcaatagctctttgagaagggaagagggtgactttatatccttctttttcaatgacatcttccacccgaagtctttcaaagtcaatttgttcaaccttaacgttgcttatggcattagctctggccatcgttgagagaccgaattcaaagaagagctctaactgaatattttccttctttttaagtccttttctgatttcttcgacttgttcttttgttaggaaggtctgtttaatttgaagtttttcaccagttccagctttaggcctgtctaagaagtcaacgggattctctttaatcttacgttttttccttaaaaataaaaagaatgagctaatactactcattcgtctctgaattcttcgttcattattgcctagaatactggtgcaaaatgcaacaaagtcttcaattaaatcaaccatatcatcaggatcttctttaataatatccacaatgtgctgattattgtaattctctaaaatgtataccagccattgattgaaatctgattgatatcccactttactggattccgaaaggttcatgtttttaaagacaaaatactttcggattaattccgcatttttggggttaattttgttgaccttttcttttgttgcatatgctatcttttttctggccattaatacaccaccgttattctgttttaataccacttgtatttaaatcttttatcatagcagcaactaatcgtccatcttttaaggattcagcagtattcttcatgactgggcgaggttttccgtaaccatagccgtatttatctggatacgtgtacccttgaccagtctcaacaaccgtagcaacatccttgccgttgtcttcacggttgttgtctaatgaaattccgttatattcgttttgaatgacaaaggagtccttcaaaagagaagtacgttcatatacaagaggatcgtatgtgtcatatacatcagattgtacatgctcttgacccgttttaatcatcgtattttttgtgctggattgtttttgaacggcttgctttgcggcaaattcaattaatgctgctatttcttttatgttcttggccattattcagcctcttgttcattctcaatctcttcgaccttattaaggatgagatcatttatttcttcaggagatatgtttgaaagtttgtctaaattctcttgcatcatctttgttgcttctccaaatttcttcatgctttcttcagggaagctactaataatcaatgggaaaaattcagagtccacaagcttaacaaaccacttaactttgtttttgatatcacttggaatacccaagtctgtaaattctttaattagtgaaaagaatccccattgaacaggatttatgcttttaaagtcaatgtttttttcttgagcattttgtgggtcagtaattaattcagtaagcattttggttaagcgggtaggggagaagtaagggtaaataaaaacatgaacgtcctcagtaagttgtactcgttctttcttgtcatatttacttacactttcttcaatcaacccaagatttaattttttcgatgccatctcatttcctccttatatatcctctgcacacattaaaaaagacacctcaataggggagaggtgtctaaataaaacttgtattttattctgtgtctgcttcttcgtagtcttcgccggtgatttctttgtactcttctaaagtgactaaaccattctttactcctaattggagctcttcttttgtcacatcgttgaattcctggtaagcttctttgacttgatcgacggttgcccattttcgactcagggcattaacccaataattgtatgtagttattttatgaacctccctttagatcagcaatatcttttaacattgtgtttattgttttgttgacttgaagcaagcttaggcggagttgggatagggtctgtcctattatttcaaaatcgttaggttcagggatacttggtttaacgctatccttgtattcttcagttgctgattcaatccatttatttttcttgggatcatatttgggcaagattattgtggggtctgggacagcagttgtactatttggaggaagagcatcgccttcaatgaagtcttctccagcgtacataaagttctcatcataataaagaacatgcataatattttcacctactaccataaaggaattcctatattaaatgaaactctggaaacactgttaatgtcattagcatacaatccatcaaaacgtaaatctccatctgttgtgaaggcaaatctcgctgttccatatgatccaattgtgggtactacaaaatccactagctgtgttggcttggttgagaatttagcaactgcagttccaatggccggcaatgttccgaaagatcctcttagccataacacattgtttacacttgagaatttgaaagggtaagtggagtattgtgtagctccattgataagtgtaactgggttccaagaacctgacgtgccactccatctggctttgtcatctaaagtaacgtgaatatcagtttttgcttcgtgggcatcggtgtaagctttcgccgagctgagtgcggtagtagctcttgcttgtgctccgtcagtcgtctcatgtgtttgccaggaagtccatgttgaatcgctctttctaaaacggaaataagtatgtgttccgtaatatgcttctaatgcgaattgtgcaatcgtagttccatagttcatgacagctaaatagacattggataagttggcaggggagtgaagcccctgatttgcgattaaataaaacccagtgttaatcaaatcattgtactccgttttttcggagctacctttgtagaatactttcccatcatcgtcagtgagtttgaaaagttgagcagcgtcccatttttctcgatcagacttgctgatatgaacattagtgtcattcagatgattatcaaagtcacttttagtagcttgttttacattgtctacattcccaagcccaacctgttcagcagtaaccttgtgtgggtttgattgatcgttagtatgttcagctaaaaaagactttgacctttcatcggagctgttccaataactgcgctcgtcctttgtgatatgtcgatccaggtctgcatcatgagcgtcaaaatcaattttcgctgcttgctgtacattatcaaccttagataagccaacttggcttttagtaactgaatggggatttttcttgtcgtcaagatgtccatcaaaagccacctttgtggcttgctcttcattaagtacatttggtaatccgacttgctctttagttacatggtgcgggttttctatgttctgagtatgcgactttaattctgaattttgcttttccatgaactcatcgaccttatcggataaacgtttttcatgatcagacatgtgagattcagttctgaaaaattgatctttaaggttattgatttgtatattgttttgtttgagctgacctacaaatttactgctgctcattaactcaccgcaattcctttaaccgtaacatctccatttacggaaatgacctcaaccatgaatttgaaaagccccgcaatatcgaaatcccagttttcatttgtattcaatgtacccgtacctaattgaaaatcagttttgtttgttccagcaatttctgtcttttcgccattttcatctacagcaaagaattttatttctcttgaagttgaggaaccagagatcttaacagtaatatcccgataatgtgatactacaaattcttcaccttcagacggggcagttgttgcttcgtggaatgtaaaggttgctttatctggaatggtttttaaaatattttcatcggtttctgtcaacaactccacctcctaaatctgtttaaaaactgacttttatttaaaaaggagaggggaagaatcccctcaaattatttagcttcaaatactcttacgtctctgtcagtaccgtcattgatcacatagacataaagtgttttaccagcggcgacaggaactgaaaaaggtttgtcaccggctgttaatgggatacctgtatcagcagttacagttgagttcccaatgtaaatcgtgccttctgcaggtgggtaaatagtaagtgctgttctgtcagtgatacctgcggtaactttttgagctgttgaagtaacagtgaatttatccgttttaaaagaggagaaaccaggatctctttcattcaaggtcacggaaggggattgtacttggatgcctttgatagcatccaaaccagcttgaggaaagtcaacttgtagtggtttttcttgtgattttagatgaatatcggtgattggtttaccagttccatcgtctctagctgaagtgtaaatgtctccgtctttgtttaaaagtgccaagatatcaagctcctaacgttattttgtttcttgcgttgttccaatgtctacactgctattcgatgtcgcatcttcttgttcagttttaattccttttgtcccatcagggttacgcttaacacgggcaaaagtaccgatcttgccattatcatcagctaatgctcggtatccaatttcaggtgtgtaggcttgtccagcctctaaggacatgtctgcttcaccagagaaattaactttaggtaactggatataaaggtcactgtaaatttttgatgtctttggatcgtactcaagtgtgtggatttcgaagtaatagttctcggagaatttttcaccactaatttcaactgtttctgcatcaacttcaatttgatagtgagctgttacagcgttccctttagcagcaaacgtttcaggaacagtaattgttttgtctgaaacattaaattcttgttgatctccgtcttcatttgtaagtgagactttggataaaggagtatacgcgattttgattgtgccggtatcacttacagtaagactttcatcttcccatacagaaatcgtctcgttttcaatttttacaccttgctgcattgccataaaatcaagatcaaagaaagcattttttacgttgcctgaaacctctttgcttgagttgatgacatacaggtctctatttccccatccgccttttaaaaagtcttgttggacttgttgggagaactgagtcatttgtgttacagaagatgcaacaaccttgtggtcactaagtcttttggttagcaccttgccaacttcatggataactgtttgttttgccaagtgttttcctcctaatttaaaatgaaaaagagactgtgaatcagtctccgaataattgctctaaatttttagcatctgctgtactgaggtggtgtttttcttctctatacatatcaacatgactattccagtcaccgattttcacatcagttgatacagtggcaaataacgcagaagtgttataattcattatttcacccattctgtaatatgacaggtacaattgataaattgtcatatcggctacctcttgatatgtgtatccattaaatgcagccacacagctagcgatgtcctttaaatcattttgagaattttggagttttaattgattattcaaatcatgaaactcctgtaattcatcattctcaacaattttctcttcagtcaggcaatgcatctctaatatcaattttctaacattgttaaatgctctctgatcaataagatgtagtgattccttgtccacaaatactttgctaaacactttaaaataagcctggttaaattcgggtaagtaatcatgaacaattttgaagagactattcttcttcaattcgataattaaatcatttaatgaaccgtcattgttgatttttgaaaagtttctgatgatttccttcttgctcattttcatcatatttagctcgcttatgtactctgggtaatctcttaagtggataaagtttattgcaccgacttcagtattaataggccttcctaaaaagaaaaaatcctttaacacattcatttacttgctccgaaagtgaatatcaatttgtatcccaagtacccttcaggcgcatttgatatgagcaaccttgtatatttaacatttttaccgatgccagcaaaattttgattgaagagcatgtcacaaatacgatcagtaattttcaggttcctgaattcggtctcctcataagtgttaatgtgtgtataaacatcaatcatcaagtcttgatctagcagcatcacactttgggttgagggtttagggattccattgccgagataaacacaaagtctgcatattggttgatcggttaaatcatcagttttgggagcacgtttaattattgagcttaatattgatggggaatcatcaactggatcataataattttccaacgtctgaacatcagggagagaagaggagagagggtcatctttataatataaaagacgattcaattctgtatcattcataatagttctaaatacagttgtcatatgttcaaccatcatactcaatcgctatcacctccaactttctttttggctataagtctaattgttccggtgtctccatagaccttggaatagtctatatcatcaacacggaattcctcaccataaaaagaaagaaaaagacccttctttaatttttcatgttttaaaaaagggatggtgacatgtgcttgcccttcaggaatgtttatagccaattctgatccaattgttgaggttgttcgttctaatacacacgggatgtcaaccttctcaccaggcactttaatctttatcggtctccctgtaacttcatcaatctttccagaatcaataagtttgtcagaagatgttagactgattgatgaattgcaaagccgcatagtagcactgtcattcattttgttatcagtggggcgcgcattaactaaccagtaactaccgtcatacaaaatcaagtctccacgatttaataagcctaaaactgtaaggactttttttgtttcgctgtcctgagtggtttgaattatcacctgttctggcttaccattcaattcaatgtcgtaagtttcaggtgaatttgctaagatttctttgaaaatttcatacttgtttgaattaaactcttcgttttcccagccactcaaataatttgaagaagaggttagataccaatctatagacatctaatcacctcaatcaaagttattcactttcagtttgctcatttttttttcaatctcatcgacaagatcttcataggatctattaacctgagctttagtattagataaacctgtcaattgaacatctcttcctacaacgttgtttaattttaaggctctgtctcgatatctgaaagagaatcctttgtacataagcattcctaaaacttgaatttgtgatgaagtaaggggatatttaaatgtattggacttttcatcataaccaagttctgtcagttcggtttcgtattcaccaactgcgttaatgaaaaactgctgttcaaggccatcagggagaatttcatttgattgaaacattgagtggaaaacgttaattattttttcataaggagtcaagatttaacctcccttatgattgagtatcaaatttaaacccagtgtattcttcaatgaacttgatcttagcgtaatcattaatcttttcttttttagctacatcaaacagctgagctttttcagactcaagtaagatttccttttgaacattttcttcgaaggctttttgggttttgtatcccaagatttgtttaattcgttctacagtaacaatttcttgtttgtcgtctttatcttcggtctcaaaacctaagtgcacacgggtttctttgtcatcaatatagattttggcatgagtaccttgaccgtcagttccagtaaatagtgaggtattgtcatagacttgggattgcacttccccagctgtgatctgtctaattccattggccggcaatctgaagtcaccgtgagagtcaatctttcggaaatataaatcccatggacataaatttttaattgtaatctttttatctaaattaaaagacatgtaatccctccaaaaataaaaggagggacacagccctcctaaattttaaattgtttaaatttgtggtaattcatattttgtgtctctgatgagaccaatttgatgttcttgtcctttggctacaccagctccaatttccatatcaaaacgagtgatctcagttccagtgataatgtcgttaccattcatcgatgtgagtccgcctttttggaaaacttgaagaggagactttttaccttgaggaatgaagaagagaagtccttcaggaagatatgttttgaagttatcgccggctttatttaattcagttagattataagcattaggtaattctacaacagaagaacctttataagtgttaagtaatcctgttcttcggatttcatccataacagactgagggagtttagtgcttgaagcatctccggttacagcctggaaccctgcaaagtcatttaactgagaaacaacagaaaagtcaccaacaatagaaggttgtccaaatcggcgaatctttgtgataatatcgtctacagatgatttggtgataccttcagtttcagcaaagtatttaacacctgttgcatttttaattgcattgaacatttcatttactacatagtacatcgctttgttcatcatatctgtttgaacttgctccatgccttctgctactttatcgaggtttccactttgaatctcacgatagttaacagcatagccagaagaaatggtttgagttccaatcgggtattcgctccaagttgtagtagcgaacggtacgtcaccacgggaagcttggaattggcttcggatggattcatgcgcgtatgatgtcatcattggttgctgatcatagccgatagttctaaatgtgcccataaaatcaaatagcttaattgctgaaataagcttaggctcaatggcataacgcacaattgtgttgatctcggctttagctacagggttgcccataagagctttggaagctagttccttcacatgggtcatagcagcattggcttttgctccaaacttggaaagatcttgacctgttgcagctgcagaaaagatttctacaataggggacttagcattcaatttagcatttgcataatggtttgagtctttttgaacattgtttaattcaactgtaaacattaataattacctccagaatataattaagcctgtactgttaggtacaaaccttttccgccaaatgtatttttctctaagacttttagagatactttaaactctgcaacgtcatctccagctttaacccatttacctgatttgtctgcagcaggaaccaatacgtcatctttaacaagcgcatcataatcaactactacgtctgagctaagttcaattggcagtccttttaagtcagctaaattaaaagcaaggacatattcaccttttagaactttgaagtcttctttattgcgaatttcaggtttatcaataatgtttccaacaacatacacatcaccttttgcagttgaagatgcacctggagggaatgcgttaccagaagaatcgttagggattacgactagaccagggactaaatcgacactagccttgcaacgtggattatttcgtacttgtttataagcaccaattgttccgaatttgaacattgagtattcctcctaaattttataaaagtgttattttatcttaataaagatcatcaatagtcactgaactttgttgcccagaatcacgaacttctgaataaatatcgaaatttgtgctattagtctcagaggcttgcttctttgagcgttcagtgatgaaggatcgagcgattgctgagttgatttcagaaataatttcgtttttaagctcgacagaaggagacttagagaacatttcaattttctcttttgcgacatccttttcttcaggagaatattcctttaaagcttggttaagctctccttgcatcttttcggctaccgccttgtttttgaattcctttagggaattaagctcttcatctgccttggctttttcatccttagctttttgcgcttctttttcttttgcatcagccttagctttttcatcctttgcagctttaacagcggcattcagttcttcagttttttgctttaagtcctcagtaagtttctcaactttttgatttaattctccaatttctttattcttattatcaagtttgttgtttaactcaaggactacttcttcttgagattttggcattaaattatcctccttttttttactgtttaattcaagcaaaatggcagcgtcgtctgcagggtcaatacctaaaatggcatcacctgtaaagtcaaatttcataggtatacgtccttgctctttccagccaccttcatattcaattgcatctgaatcttctacagctgctatctcaaccgaggtctcagggaaatcgccatcaaacatttttgattttaaccattgaacaaatttaggatagcgctggttgtataggaagccttcagctattaacactctttttggctcaccattaacatcaatagtgtcaatgtaagcattggtagtcgtaccaaccactgcgctgttttcaaagagaggggtgccgtccttgacttctgttaaaccgtgtccgaatggctcactgttttcatcatccaagaattctgcgcaaattggcattaacttgattgattcaaggttagcgtttatgtatttctccagccaggtaataccgttcttgttgaactgagtattgttttcatggatttcgagaacgacccacttgatgtatgtttgaccactggtttttttctgattgttaatttctaaaatcgtgcttttcaaatactaatcacctcctctcaagagccagaaggcgttccgttactgttatttgtcttcgatttaatcgtgttttcatttttcggatcatcgatctcaggtgcgccggctgacttatcgttattcttactcattgtgaaagaggtcgcatgaacagggaacttttcatcaaaaccttcgtctttttcatattccattagggataagtaagcatcaggattccatccagtagcggctatccaagcaataaggcttcctcgaccacttgtataaaggtctttcatgttttggactttttctttcctgttaacgtgggtaagagggaggtagtaaacctcaatataagagcgaggatctttgatgatattggcgtttatcaccttgttaaactcactttgaatttgttctaaccaggagaatatttgggaagaaaccatctcgatattggtttgttgagaagaatagttaccgtcttgaccattgagagcagatcctgcaaatcctaaatttgtagtgattcgtttaatgagctcgtcttcacctttaaccttcaagaaatctacattagtttccaacttgtctaattttgttccagaggccaaagagaagaacttaacacctttaacgcttcctttagcaactaacgctttttttatattctcatgctgctgctcctgttgcttttgagataaggctgatttgcctttttgatcaccttcagggaaagtctgataaattaaagtgctgttgagctcatctaaaatgtttcgtttagtgtcaacaaagtattcatcataaaccatatcaataaatgcggataaaccgattgggcgtccccattgatcttcaatgtcgctacttcctttaacagcaatagtcttattgttatcaagaactaaccattttcgattttggtctttcttataacccctatagccttgtctgatttcttctggccatcgtctaagcttgagcgatctcccgttacttgtgaacttatcaaaataggagacatcaaaagctaactgataagaggaatttttccttccgataattttgcaataatcgagaggaagagggaggacggaacaattaaagtcgtcaatagcatttgattcagttattgatccgatctcattgtcacttagagtggtggggaaagaatcatccactacagaatcaaaataataaaagccagtgccatatttgctgagttttcctaatgcatccctgacagcacttttgtcgccgatttttcttaaagccagattgaacttttgtttgttcgatttgaaattagctactttacttgatcccaaaataactctgtctaaagtagggagggctaccatgtagtcaataacgtttctatacacaccatttgcgttataaagcaatttagaggcatccctaatctgtttattgtagacgttgtggtctttcagccatgatttaactttgtcgtaagaaataccgttaaataaatcattaaagaacaatgaatcaagcggcgctaaatttgtattaaactcatatgatgactgtggttcagatgtagtcattattcacctcctcaatttctaattaaaaaagaatccaaatgaatactcatcatcggattcttccttttctaaaaataaagctatgtaatacagcgcataagcaattgcactgtacctatccttatcaattctttttacaacttgctcaacagtgaaagaattctgtgtctttttaattctgaggtttgctacttcgtcaataaacaattgagtttgaatacatgctgcttcaatcattacatcatcagatatgcttttttggttcttgatgtcatcataggatttaagcaacttcaattttccggactcaacataatccaggaattgagtaataatgtcttggttaataccttgggattttaggttgtaaacgatttccggcgaatttgggacatctggcttttgatcagtgtttattgtggcccagcatccaagttcttcattggtctccggatccgtaacatcctctaataaccggtcgattaaaccgccaccgactccgtttccatcgacaataacagctttaactcttgagagagaagtatcttgatttcctccatagtttttgaaaactctttttaccatgattgattgttctttaaaactcaatccgtttggtggctctataatattgaccacttgaacttgcctaatgaggttattgctgtttctgattatcttcaaaacaacgatagctgttttattgtttgattcagccgcagagcgggctacgtctaccccgattacatattcatgtagcaagaagttcttatttttatctctaggacaagaaagttcagggtgggtaattgtccgagctttgatcaatttactgatattaatcaatgcgccgtcacttgcaccaatccagtcacaaaggtaattctgacggaagcgagttacattcccttgtcgcgctttattaataacagacattttttgacgaccaaagtgaataggaatgcgccaatctgatccgaatacaaaggatcctttaagatcaccagtttccttaaccatcgtaaggattttttcgtactcatctgagtttttatatcctgatgtggagaaccggttaatctgcccatttaattcagcaggatctatttcgccagtcatggttgtacgagggatgttaaaaatcggctcgatagcatcatcgtataaatctttatcaatcaaggcagattcctctaaggagccacgtcttctacgtaaacccttagatgattgggcgtttgccaggttatcgatgatcgccccgttttgaaattcaactcgaccactgtcttttgaaaagttttcactcttgatttcatctttaatggaagggtaaaaccttaaaatttcctcgtgcttttctttccaaattttcaccgctgattcctttgtagaagcggtaatggctaacgttacattaggaaagcaaatagctgtatggtatgcaaccatgatctgggtcaatgtattatgactaactaatccattacttacaaatgagttggttaaaggcatatatagatcataaacgtagttctcagagtcttctgtttcaattactttagtgtaatagtaattagaatcataaagctctactaaatggttgaattcatcgctatctttattatcaaaacgctcattttcacttaataatagtgataatttttcgtaagtaagatcattagatcctttaagaacatgataaaatttatctcttgttttacctttaggataaattgctataatgttatcttgctgataagggatgacatctttatttggattgcgatttttgttacatattgatataagtttttcttgctttcttgaacaactaaatccaatttcccgtaaaaaaagatcaatattctttgtagaaatattgatcttataatgataagtattaaattttttatttagatatttttttctgaaagaaataataccaaagtttaaaagtaacatttgaacttgtttactcattttttctgatgcagtgcaaaattgtacgcttttatttgtcacacatccatcggtatcaaatagaccttgtattgtttttgcaacaatatttttaggtgctttaagtataattttaggtatttccttaccaaaagcatctttttcttccagtcctaactgtctgaagaattctcgaatgagcttaccaaatacgataaaattaattctatctttttgcttaactgcaatacctaatacgttgttaaaataatctatataattatttaatatatcttcgtcttcatttgtaaaaagtattgaattgtttctagtcaagcaaccatcaccaagaagataaccaataattaatgctaattgttcatcaatgtattctggaatattgaatttgtttctttctacttgccatctgccttgattgctaaatccatttaagaaatcatcaaagcttacatttagctttgtttcacttccaaatacattattgtttcttgaaataggtaataaatctccaactttaatttcactagaatttttgtatcttagttttccatcttcacacattactaatactgggtgatttaaacttgcttccaagtcatagccatcttgagttttgattttcttcgttttcttgaatccgcttgatatgccggccatagaagtttccattagaccatatctgtttttcattgagattttatgtattgtttcaacttcagactcttttttttcgtaattgaatagttcgccaatttctactaatccattttcagtaaataaaactgtgtctcctgcaacacattttgatccgccacgtggaatacagaagtagttctgagggaagcgactgagtgttctcatcataactctttggtataaatccagctcaattccgccgacttcgggtttcaacatatcgtaaaaaatgtctggataaaaacgaataaatgaggtgaactcagcccatttggagatattcttgccaatgaagtttgaattgtcatctggattcagaggggtttcaaaagctgcgtcgtaaatatctgttctgttttttgtgtgcttcttgtttttcgaggtgaagtttttataactagccattaatcttcatcacctgtgtcataaagaggttctttgtacacattctccaagtctctgaaaacattgttgcgagcactctttagtttatcaatttcttcaggcgacaatccttttgatttgaagtcttcttcaagcatttcatcataaaaatggtaaatgtctttgtaatcgactttttccttatcttcgagccttctgtaataatttataatcgcccaaatgattagatcagcgtcatcatatggttgggctgctaaacgaggaagaaggggataatgcccaattctgtttcaacggcttcaaataattgagaaagtacatcgactccaccactgatatcgctcttacttaactgagatacattaatttttgcatctgtagctgcctttgaagctaatgaaccccattctttagcttcttttacatcacctttagcagttgctaattcctcttttacacggaaacgaatatatgaaagcaagccttcagtatgaagtgtggttttttctccgtaatttcgaataagtttattgtattttctttcaaactgacggtactcatcgggggtgtaaccaataccccatttatcaatcaggtcatctggaatttcagattggctaacaccagaattgtttgtaggcgtagattcctctataagtggcttctctggttgtctttcaaaaacactgtctttataaccagtaccgttaaactgcttcaatgaattagccattgtcatataagcactaaatgtatctgtttttctcttttcagcttgttcccaatacaacggatcaaatttaacatcgatctgctgtaagactgtatatattgactcaatattgctgtaatcaatgtttttcttcaagcaagtcttgcaaatagggacttttcctgttttctcatacagactacttcgtgaattatagaaccccgactctttgtccttttctttttgacaagcagcacagatcaatttttccttttctttagcttttcttggcattggttcacctccaaaattttggttcaaaaacacgttttataaaacgcccagcaatagagagggagtcgagatttctcaaatcatcactggacgttctaaaaaagtattttatttataagttaaggcaccgttttcggacaaaacaaccttggttccttttaaggtatcagcaagagcatccagcaaaccttttccaataccgtttgcatcaattattaacttactcggtcgtttgtctataataatggcttttatttgactagcctgatgtttaaacgttccatgctccactttcttagagatgtcctcaatacgggaattatttaaatcaataattaaaaaggttgtttcttctcttctaggattaattacagcaattctttcaggattgtagcccgtgctcaatgtgtagctagttccgtttaagggtttagtagagaatttgacgtctcggttcaattgttcacttttagtgtttttctcaaatcccaggcttttatgcagacttgtcagggcgtcttttaattccctgttacacagataaccactatcattaatttcttttagcagctttacatattcccaaagaattttagtttcttctttcaatcttcctcatcctcatctttataaaattaaagttttatattaattaacaatcaaatttactagagtgctcttactttcaggggacaggttgtcccactgcactgctaatatttctataaaatcgtttgcagacataggatcattccttttacttttcatttttaaagcgaattatgtatgtagcctcaatacctgcatcatcaaaaaccataaatttttgagaaggttttgtgccaaaccgaccttgcatagcataatcatccgcaccaacaagcgctccgtttactacaacggttgtgctgccgtactctttttcataattgtgatgaatatgaccaccgaatatgtaagaagggatgtagccaagtaattgaggtaatcgtgttacacactgatcaacacgatcgtagtgtccgtgcacaaacacgacttcctgattgttgattttagcggggatgaatccgtcttgctcaggttcaatggagatgttctctatgttctttaatctggcttcaagataccaattaatgaggtattcaaagttttctttaatccctacatcatttttagaaggggagaggcgaccgtgattacctgccacgttgtagaacttaacctcttgaaactcacttgccaacatcgctaaaacctcggcaagcgtttctgatacatatttaatttgttctacagcatcttcattggcctgaactcttgtagacacatgaataagacctccgattaaatcaccgagatttgctacatgcagtgtggaaacatgattctgcttaccatactcaatcactttgttggtgagatgttctacacgttcattaaagatttctttattgaatttatttatgcggttgtcgatttccattccgaagtgccaatcactgaatagagcgagtccatgtttttcagcaatagcaggtgatgggaaggtgaagcgaaggggtctttttgactctaaagatgcaatagcttgtacgacatcatctttaatttgttcaaaccgtgcttgattggcaatgaatttccgatattctcttttttgatctcgtgctttgattgtttgtttttcggattcaatgcgaatttcttcatgtttttgttgaacttctttgttcatattctttgagataaagtaatcgtgccagcgctcaaattgtttaaagtctttacgccatttgctttcatcatagttggttccctgatccttgtttaaaagggcagcaattgtttttgtgtcaatgtgataagtgtctttgtttttgaaaagtctgatatgataatcagtaaatgattcgtctttttctcgttgtaaaacagtatctaaaatagctgtcattcagtcaccacctactcattgatttgtggaagttcgtcttcttcggtaatagaaattttcactttccgaccgtcaaatgattttaaaatagaattcagatcataacgctcgatgtctgtttttgtttcttcttcaataatcccatcaatgtaagtatagttaccttttaaatttactgtatgaactttcttagccaaattaaattcctccaatatttgttttatttacgtacaataagctccttcggaagcccgatgatccgaaacatcggtaacgtccgaaaaggggatataaggagatgaaaatatgagtcggataggcgttggggaaacgcccgaaggagattattgaaaacttgcgtaccagaagtctcgtaaggacattccggctgatcagtaaagtaaaacgcaagcacaaaaagacctccgccgtagggtgcggaagcctcgttctgattgcgtctatacaccgagatcaggacgcatcccttactcgctcgcttctctgccggacaatgccggatgtatagttggcgctgttggcttttagcaagctgcgatagcttgacacgccgccttggctattcgtttattatgcggacgaggatttgcacctcgcatggacgaatttcaacaaccgttagccaaaccgactattaagtagcccgttgtctacctcacagcatcgtccttatgttcgtctaagcgtctacctattccgccaccgcatcgttaggttttaagacactcgattctaagattacctgcgcttgattatacgcttcctcataatcgccgctcttaaactcgtctaatttttcccggaattctctatgacgttttaagtaagcgtctttgtcgaatttaatacgtatcggcattttcgtcctcccttgaaaaatatacgaaattagcgtttttttacataatattcattaactcacgtaggtacgcaaaatcgacagggaatacgctgattacgggttcatcgttcgaaatctttgtaagtcgaaaataacaaaagacgccaaataacgtcttcagaaactccttgtacatcatggtacatgagcataaaaggctggttatcgctgtgcgaaatccagctggctccttctacacctggcagatgagctatgataacaaaaatacacgctttaagggacgtgttaaaattcctattacctttacatcttatatatcaagtttttatgttgcttgccaactgctcagtagagtctgagagccaagggaaaaataatttgagaaggaagaccctaataagccttctcaatggcattttaaatgctcttgtcgggttacacgccttattgagaaacaaagcgtctcaaacgctcgccatttattttgcacagttttctctgacccgtgtaaggaggtatgtgcatgggaaaggtaagtctccatacagaacattgaaggagatgaagtgaaataaagtgaacgtgttgctaagtgaaattgaaaaggcaagaccgaaaataatccttttctgtgaaatgggagcggtgatcaatcgcccaaaaaccatctcacttattttgcgaggggatgtaattacaaaaagcctcgctaacccggaaaaatttttatgtgaccgcataataagcatcaaagcttacaagggcattatttaaagggaagggagacgcatctaccttacctaagtgcaagccgaagcaatacaccgcaattaatattcaggctatatgccacccataataagaccctgatgggattcagtcgcaatttgcaataatgcgttaagtcttaccgacatttttagcccgataatagccatttacctgtctctttttagatacagacatgcgagttaacctcgaaccctcataagtgaccattatccgactaactacaatgaccagttgtagctgtaaagtcgaatttaatgcttttgttcgtatgaaagtgagaatagcaatgtttagaaaaagcttaatccacgatggggcaataccccgctaatatccacttatccaaaaccctggcatccaagacctcaaacaaatgaatattagcggagaactgatatcccacatatcagtaaacagcttattattgacgacacccccatgccatcaataaaagaactctaattaataaacctggagatgaatacatgaaaaaagaggggaggtcgacaatttcctccataacttctaactctgccacttttaggagcataagctctatgtgacaaaggcgtgcaggaagcctttcctgtcgtcctcagtaaattttattaagctttcactgcgtcttttagagctttagcagccttgaaggcaggtgcctttgtagctggaatatcaatttcctcacccgattgcggatttctccctttacgagctgcacgttcacgaacttcaaacgttccaactcctggaatcttgattgattcaccttttgttagtgcttcaatgatgacattaaatactgcttccactttaggtgcagcttctttcttagtaactcctaatttttctgcaacttctccaacaaattctgttttgttcatgttttaattcctcctagtgattttgtttatttttgtgttaaagtataattacggtatcgtttgtgcttcttttgaaaaaatgggagacgtactcacccttatatgtggaaattagctttctttctcccttatggcgattatctcaaaaagggctttcagaccagttatatcaagggttcaaggggattttttcgttaaactttttccggtaaaatcgctgtaccccttgggggagtaaggctcaatacactttctatttcgtcatttttttcttactgtattttttttgccttaatcgatggttctttttttcaatttccaatgcacatttattacaatattttgatttatttgagattgacttaaacatctttccacaactataacaagatttaaatctttttaaattattctgcatgttttccaatattagatcgccaaagcactcccataatgttgatttaaatttgcttttctttttatataaatgcttaaccaaaacatcagcaacagattgctcgtcattatagattttcagcaatctgtctttaatgaccttataaacataaagtttttgcccaggcttaatgtcttcatcattcatgagccatttcttgttctggtctaatcgtttatattcacgaataattgcatcgtccaatttaatatccctgttcttgagcaggaagcggtaatcaaattttcctgccactgctgcgaaattaattcggtcagaagggataatggagtctaacttatttactgtgctttcattaattaactcaacactatgttcttctttatcctttgcattgataaagaagtgaggcactttattttttatgtaatctttaattttttcatcaacatgatcaggacgggtcggcatgaataaggtttttgcaaaatcaatagtaaagttattttccatgcataaccatttgatcacatccagatttatattgtcgctgttccatatcttagtgatgttgttgctgtactccccgatattgatcccataagcaagagttagtgcttcatagatgttcctgctattaatcttttgtttctgggctacagacatttcataatacaacggaacgatgttttccatattacgcttggcaatattgacgattaactcatcagaaataattaaggccttatccccgtcattatcaaactgcagcaacttagatatcggatcatgaatgcttgtgtaaacacctggggtaatgaaccacttttcatatttctcatcttttttgttccacctaacaccatgctctctgaataggtgaggggagcggaggatgtcaatatacccttcatcatataaagaacaatggacatcatttcctgaaagcagtccttttggattctggatattcagaaataatttttcgcagaaagcatatagatcagggcataagtatgtataacgagcaccatcaacaagcaattttcctgatttggcatctttaatcatgcttttctttttatttttaataatttctttcgtgtgatcatcgttaagaagttctggatatagaagtaaagcgtcctgaagagctgtccgatgtttctttttctccgtagctccaagaactcttaacatggtttctttgtcagttcccaatgtggtaatctcttttacagtctttgagctcatttgaattaattcttcaccggagatatctgtaagtgtttggagcatttgataagtgagcttcccttcaacagaaggatcttcttcgttgagttttgcccctaagcatccatattttttataattgccttgatattcttcccacgatgaataatacttccacattttaaactggcttttagtgaagataatttgaacatcatctttcactacgtcccattccttgccgtatatatcagttactttaaaagctttgttttcctcagcaaatttgcgaaaatcaaacgggactaataaaccctttacccatgggagtctgaccatgaagcttttgctactcagagtggggagaatcattccgcagccatccgtatgctcaatgggaatgttcattgtttttcgtgtgatctcgtaggtatctcgatcaatatagtcaacgagactcgacacatcagtttctaagtcgtcgacaacaatggctttatcaatatcaatctcccaagggctactggcactgttagataaggccatatagctattccatttgttaatgctgctaccaccaagggagttaatcttttcaatactcaagccgcatgtcaaagcatcctgatacttatcgtaggtgctttttttaatgaaacatgacttctttgtacgaatttgaccggcactgctcgtgaaataaacgtatttttcattgttatgtaaaaatccctgatcaataatgtccttcaatacttcaaaatggtaagtctggacaaccatgatttcctctgaaagggtgttttctttaatccctaatgttcgggtcaacactgaatcaaataaagaaatcactttattgtcccttaagctgtcagttcgaagtgttcttatgtcattatgttcttcgaatgcagaatagaggcattctttaaggtatgtaattctttgtgaaatgtatttcttatgtttattatttacattgtctaatgtcttaagataatctctgtatctataagacttcaaaatcttattatgtaatgaattttctttgtcattataaaatgctgatgtgtccacgctgtatatgtgaacttgcttagacaatccgtctttttttcttttcaatcaatcctctccttactattttatttttactttaaatgtgcttaatattcgctattaagatattgatttactaaacttcgatatgtaaagctttgcttattaatctttccgtaccatttgtaatcctgataaaggtattcttcttcgggtgttgctgtaccatcgactacttttccctcaataaaccccattaaatgactaaataaatactgctttttcatcttacacctccatactattttatttttactcttaaaatgattaaaataaagaccacttcatgtggttgtgtctttattatatattttatttttactcttgtaaacataaaaatccaaagttaattggatttaatttcgattaattcaaaaagatcgtcaactttacaatttagaatatgtgccatcaataaaagattgtatgtactagggaggacggttgcaaatccctcgctgtcatttttacaccatctagatatacttgctctttcagcttttatttgctctgctaaccagcctttttcaatacctttgctgtttagaaatgaatccaacttacttttaaccctatattccatttaaatcatccttttgctgtttgaataaattttataaaatgactggtttacatacaagcagagtatgattatttgcattaagatacaaaaatatttgcatttaaatgcaaatagacaatataataatcgtatatcaaccaagatacttcagaatcatcagatattaaggaggggtcacatggatacttattttgcttctgtcattgacaacttaactcgaaatgatctgtatattctaggcttattgagcgatgaaggggctgatttaaagtttaaatcaattaggaagaaaaccattcaagctaaaactcaactaactgatgctacttttagaaagagcattgatcgtcttgaggccttgcagtttattattatagtgaaaaacagtaaagagcatacaatttttattactcaatatggtcaagaagctttgagatatcaattaaaaagggagagggtttaatgtttggatttattggagttggtcaggccggtggaagtatagcggatgaagcaatgaagagaggatttcattctgttgcaataaattattcactttcagaccttaattcattaatcaatattcaagataagcttcatctggtagggacagaaggagtaggtaaagacagaagcgtagcagcgaaacatatgaaaaataactgggagtcctctattgagttcataaagaacacaatggaaaagccttcagtacaagttattttcgtagttttctctgcagctggtggaaccggttcaggagtagcccctatattattagaattgttaaacgaatgtcttacacataaaacaatagttgctgtaccaatccttcctgacaataatgaggtattggttaaccagatgaatacactggagttacttgatgacttatctatgccagagacctgtgtcttacctttggataatcaaatggttttgagcaaatatgaagggaagatttctgaaagcagactatacaaggagacaaacaagatgttccttgatttaatcgaagtcttactcaattacacggacagaggatcaaagatcagtacattagacaggaaggatttaaatcagctttttgacacaccaggaatcatgactattgctcaaacagacctcaatgaatttacaattgagggtaagtattttgataagctgcatgaagatatacagaagtcgtggaacaattcgatatttactcctgttgagtttacaaatgtgatgagagctggtgtcattctggatgttcatgagtttttaacggagcatatatcgtataatgagctgtttaatgtctttgataacaagatgcccctagacttatttaaaggacattatgataaagggaatagggcaataaccatccttagtggattaacctggatcaatgagcggatgaagcagttagatgatctaattgaaagtggaaacactgaagttaaagaaacaactgtctataaagcgaagaatcgccgtagagaggatttattcaagccgaggaagctggagaacaaggaatcgaaaaagacctcgtatatggaggcactgaagagactaaaacgttaattttaaagggaagctgcctattatggtggcttttttattttgatttttaatgacccccgggtgatcgttagctataaaagtgcttatcgtaaatgaagatcagaaagggttatttagttgatatagcaatgttttagggctgtcaaaggggataataggtgttttgtgatcgtaaaacgtagacaggagagaggaaaagtggttgtttatttaaaaatctgatgaaaaaggggagaataaggggtggaaaaacattgatattataggcttttacgatagcgattacgatgtgaaaataggctgaaaaatgggaaagtgaaaaaataagtttggtgtggaaatggaagtgctaggggtacatttgttcctattttttggcctttagatgttaatataccccctatatattggtatttaattccctatataagatacgttatgtagggtttttatgatttaggtgataaatttgcacagctaacacaatttcaaatgaaaaacaatatatatttttgaaaaaataattaagcggtcaacttaaaagtgaatacccattcattaaaataatcgtgtatataacgaaaggaaacaaatcgaagtgttatctatacaattcctcatctaactacacacctattttatattcatccttaatgttcatcttttcccatcctcattacattgcatccaccataaactatcctcagcttacctaatcatctctatccgtttccttcaccatacatcatatatccatcctatacacactaagcacacatcatcagaagcattctaatccacctagaatcaattttaatttaatcatagtatcattggtatccaatccacatacacgccttatacagcctataaatagccatgaataatagtgccaaaataatttaaaaaaatccattttaagagtaaaaataaaatgactttgaaagggaaatgtgctataatagagttataggaaaggaggtgtacatagtgcttgagaaagtgggtataacaattgctttccttattcctatcacggttttaatcatcaactgtttaacgatagctgagaagattcaaaacctgatgaagaataagaaaagcaaaaagcgtacacgcaagcgcctccgtagcaagagacaacgcaaacgtatacgcagataacacgctaaaggggaattaatcccctttagtcactacccatattataacatggacaagcacattgtaaacatgaaacgattctcattatggtttacgaacataacatttgttgttttattcttgttgtttctgttcatcaaagattatttcagcagcggaatacagtcgctgattacggctatcttcatagtaacgtgtatcattgtcattttgtcatggatcatttattttactttacgtaagaggttaaataaataaagtttgtggttttctggatattgatttacaaaaaaagatcaaaaagatattgatcatttaaagtgatcatgatataataaagttacaagttaagaggaaaaatacaatgtatataggaggataagaatatgattacagaagatagaatttttgaaatagaagaggaagagacaattgagggatataaagttagacgtgtgaacatgtcagaattagaaatcattgatagagaaaaaattgtatttaagggggaagaggcagaagtagctgaacaccttaactcactactcttttaaatatccattttaaaactctagccgatgcttattagaggtgagcgggataggaaacgaatccttgagggtatacagtatctttccgcgaatgtagaaagtgaccaccgatacaatgataagaaattctctggtcttgaaagacgtattcatgatcttgaagaaagaatcaacaattgaatttcatacatgagaaggagcggtaaaacatttatccgttcctttatttttaatattaaagggggaagtctacacttattatgaataaaattaaaataattgattcggttatggggagcggtaaaacatctgcagcgattaacaaaatgaattctgctggtaaagaagaaacctttatattcatcacaccttatttaaatgaagttgagcgcataaagaaaagcataaagtccaaacaatttttcgaacctaaagtaaagaagaaaggtgataaaacacaatataagtttgaatcctttcacgaactcttatcacaaaataaaaacattgtggcaactcataacctttttaaaaacgcaaacgacgagacaaaggaacttatacttgcaggcaattacacactgatattagatgaagtcatggaagtagtggaacaattacaggtaaagaaacatgatctaacaacactgtttgattccaatctgatttatattgaaaacggttttgtcaaatggaatgaagaaaaaaaagactatgaaacacgatacgatgacattcgagatatggcgttaaataacaatctaatgtatttcaaagacaatatattgatttggaactttccagccgatgtattccagttattcaaggaagtttacatacttacatatatgtttgatgctcaaatacaaaaatattactacgatctgaacaacattaagtatcaaaagtacagttcagcttacatggatggacagtatagcttcattgatcaccgtcctgattatgaaaggagctttaaaaaagagttaagaaacaaaataaaaatatatgaaggaaatctaaacacaataggacaactggagttttcactgtcttctaattggtataaaaataaatcaccttacaccatcaaaaaggtgaagaacaatgtattcaattactttaataatattgttaagtcgtcaagtgatgaagctatgtggacgacttattcagaccataagaacagaataaagggcaatgggtatacaaaggggtttgtctcatgtaatgcacgtgctacaaacgagtttaagcataagaaacacttagcatatacaataaacagatatacgaatactgttctgtataattattttaaagaaaagtacagtattacaatagaccaggacgcatttgcattgtctgagttagtgcaatgggtatggaggtcagctattagggatggagaagaaataactttgtacataccttctctaagaatgaggaagctgctcacaaactggctcgatacctgataaagaggacaaacctcttaaacttaaaaaataagccagtcatatcaacggttttagagcctaagtcttaaggagaaccagaaaaataattaaataaaaaataataaattcgtccgtaaagtgcctttacggccgtctcgtttcagcaagctgaacctcgataataggattttctttatttagaataaaaataaaatatctattgattattttaagtgatcatgttaaaattaaatcaagtcaaaggattacatacatttaagataaaaataaaatagttataaagaatggagaggttgaaaatgacagctgttttaagaattaatgaagagttaaatggaattgaactatattttgatagtaaaccagaacaagaggttttaactcatcttaaatcaaacggttttcgatactctggattcaaaaaatgttggtggagcaaacggacagaaaaatcaatgcaggtcgctaatggtgttactaaacaagaagtctcatcttctaaaacaatcacaaaaaccaaaaagaaagctaatggtgtaaatatgagtctgtgggatgcaacacaatggagtgaattagaagtaaataaggaacaagaagtaaaagaaatggcaaaggaaataagaaagcatttaagacaacgtctcccacaatgcaaattctctgttactactgggggtagctattcacatagcactattaacatcacaatcaaatcaagtccttatgaaaaaggctcagcttatttgactgcgatttatgattattgcaacagtcttttaaacaattatcgccattgctacagcccagcagatccttacactgactatgctggaagctacaatttctatggtcgtgtttcattagattgggaatacacagtgacagagcaaacagaagaaattaaagaagatatgacactgtttgattcaaagatggaagaattcgaagaagccgagaaagcgagaaaagaaaaagaatttcaggaatatttaaaagaacaagaaatcaaaaatgctgaatataagagacggcaagaagaaaagaaacaagccgaaaatatctatagcagcattgtagtaaaacaactgaatgaagatcaagagtattttgttattgatgcacagtttgccaacttaaacaaaaatcaagcacttgatcaatataaagacgaggttgctaaaggtgactacagacttgaaaatgtgaaaattacaaaagaagtgcatttcaatactgaagaagctttaaacaacttttctaacttgcttttaaatgattttgattttcttgcggaaaccggtggaagttttacggaagacaacaggatcaactcaatgattgattattacaatatggacgatttagaaaagaacacagttaaatggaatttatatggcgtaggagtgtactacggcgggaaattgcaatttattgtagacgctcaaggccattcttatgcaagatacgttggtttagtggacaatgcaaaaattgaaaagtcaatttttgataaacaagcgataaaagaaggagaattagacgagttaaaatatcaagcgggaaaaatagaagatctttctagctcagtcattgaagaattaaatatatttgcaacctggaataatgaagactgggacaaatataaagctttactcaaagaaaaattgaaattgaataatttaaatttgagtaaaaaaattatccaacaagcagatacagaggaattgaaaatttctttatacagaattctccatgaagttgacagcattcaagaacaatttaaaaatgctgatcttgaaaaaggtgaaaaatatactctgttttacatatctgatcttggatctttaattactgaaaaaataacgtatgacagttgccagtcaactaaatatgctcaatatgataatgcagtgaagttgacatacaagcctgaaaataaaagaaatttatattaccgacacttctattcagaattattgatgttcaaagggtggcactcgctgcccgaaactgtgttgaataatgtagaggttaaaccagatgggactaaaataattcacagtaagtactactcgtgtgacaaaagacaatttgacgaggttctaaattacttaaataataaaagcttcaaacctctaatcaacacatataaacctagtctataaaataagaggggatgagaaaacatctcattccctaaaaagggagaacaaaaaatgtttaaagataatccggatttttatccgacaccaccacagttaatccgaaaaatgacatcaaaaatagaatggaagcatattaagtctgttttagagccgtcagcaggtaaaggggatttggtagaagctattcacaatcaattcaaatacaccaagaactatagagggaattcgaaatatgatattgattcaattgaacaagatgaaaacttaaggcacatccttgaggggaaaagttatagagtgatagcagacgattttctgacgtttaacacttacaagaagtatgatttgatttttatgaatccaccttttagcagcggtgttaaacatttattaaaggcgattgaattaattgaaaagcaacaaagatccggccaaattgtttgcttactaaatgccgaaacattaaaaaatccgtattcaaatgacaggaaatttcttatacgtaagctagaggaaataaatgcagaagttgaatacattcaaaacgctttttcgaactcagagcgaaacacagaagttgaaacagcaataatttacataagcattgaaaaacaagaatatagcagcgttctaatagaagaattgaaaaaagatgagtcacatagaattaatgaggattataaagcaacacagttggtggactttataaaaggaattgtagaacaattcaactatgaaatcaaagcgggtttaaaattaatcaatgaatacaacagtttgaaacccttaatgctgcatagtttcaatgatgacagtactccaatattgaagctgctaattgataagaataccgaagaaaatgacatagagaatgcatatataaaacaaattagggcgaagtattggaatacgttatttaacaatgatcaatttatggggctcttcacaagcaatctgaaacaaaagtatttggagcacgttgaggaattaaaagattatgacttttctttgttcaatatctatacattgagaattcagatgagcaaagagatgacgcagggcgtggaagatacaatacttaacctttttgaagaatttagccacaagcattactatgatgaatcatcaaaaaatgtgcacttatataatgggtggaaaacaaataaatcatataaaattaataaaaaaataattattccactaaacgggtattgtagttggctcggtcactatagtccaacagactacaaggtcttagaaaagttgaaagatatcgaaaaagttttcaattaccttgacaacgggttaacagaagacataaacatagatgaatctctaaaactggctaagcattacggtgaaacgaaaaaaatagaattaaagtacttctatgtaactttctataaaaaagggacatgtcacattgagtttaaagacaaggaaatgcttaagaagttcaatatttttggcagccaaaagaaaaactggcttcctccttcgtatggcaaggtaaaatatcaggatatgacggcagaagaaaaagacgtaataaatgattttgagggggcacaatcttacagtgatacggtaaataacgcttcttattatatactggatacatcgaagcttctcttgcttacatcataacaaaatacacactttaagaataaaaataaaataagtattgattatttaaaatagtcatgatatacttaaatcaagttaaaacaacagcgaaagcatacatattttaagggtaaaaataaaataaaatgcatattttaaacagaatggagacattaagatgagtacatatcaagtagatttcaatcaattcagaggaagtatggaaacaacatgcgacctatataatttagataacaatacaacgcttcaaaccagcctttaccgtaatactaatagcctttgcattgaatataaggtaattcagcgtgatgataattcaaatagttttgcggagtacgatacacttgcccgtggttacattgaagtacctttgacttacaatcaatttaagaagcctgtaaaaaaagtttatctaaataaaataattaacgcactagattttattattaatcaatatcttattatagaagatacttctcaagaaattaacgaacgagttcaaatgaaagtgagtgcaactaaaataaatgaggaagatcaatctgactttacgaatgaaacctctaattcaccaattgatcaaattaggatggaaagatgggacagggaatatgacgagggagttaaatatttctttgataaatacgggaataaacgtataggggatattatttatattgatacacagcaagagcttgagcatttagaacacatagactgtgataatgtgataaggatttttgtagacaaagagcatgaaaataaaattaaagctattgtacttaaagatataaacaaacattatcaaagaagtggataaaacaacaattttatacaggagatgatgaagtaatggcagtaatgaaagaagtgtcaatagaagaatatgatttatttagaaaatggtatttaaagtataccaatagcagagtcctaaaaacaaaacagagggcagggtttacggctgttcttgacaagaaaacaaaagaaactgtttgtagcgaaagtcatcttatggggaaaagtagatacttaattaaacaaaattattatgatttatatgcagaggaggatgcggagtaatggctaaatgtaatgattgtggtaatgaacgttttttctacctagaggtatcggtgggagccaaacagcttattgatacaacaggtggagctaggaacggaaagatttatgatgtagactattcagattcaggtatagacaatatcttcaataaaggtagttatatttgtaaaaaatgcgaatcgaaagacgtacatcatgaggatggcgaaggtgattataaactctataataaatctgaataaaacagcagtttaataggaaaggggaattatatgcgtgaattagaattattgctcttagtgatgtgggcagaaaatggtgttaacgaagtttataagtataaaaatagaatcaaggcattccgtgatccgttggttaatatcgagttgattaatgacttgagttgcggaggtatgtttgctgacattgacgacgttgcaaaccacaagaatgcttcgtcagtagattataaagtaagtatcgcaaccttagttgaaaatagaagataataagataaatattttattaagaggaatgcctgtctaaataaaaacaccatttaattcgaaacgcttctttatcatcgcaaagaaaaaatgtaaaatccacctattggcatgagttgtcaatgatattgagacgtcattggggggagaaatttgaaaaataaacttgaaaaattgcttcttgaaaagggtgtatgtgaatttcatattaaggaaatgaaggacaccaaaaatataagtgagtatccatatgaattgtattatgatgaagtcggaaacagcgaaaaactatatcgggatgtcccgttaaaaaaaattaagagtttaggattcaggggaaccagtggtgtgtcttggtttgatcacgcgtgttataacggtacagataatattgacattggccgatgtgaaaaagcttttgaatacttaaaaaaacaaagtctagaagaatttcacacttattatcaacactcaccagtgaaattggttcattatgaagatgatgacttttatgctgtttacggtgatggaacacaccgtacaatttgggccaagataacagaagctccaacaatttatgctcaggtaactagagcaagaaagaatccttccttatataaatcatacttaagatttaaagaattagaatcacagattaataggtattttaaggagaatgaccttagctggggagttaaaaaaagccaatactattcagaaatcctttacaaaggtatgccagtagcactctattctatagatccgccttactcatttaaccgatcttcctacagtctcaatgatcaaaagttggatacatggaataaggaattaaatgaatttatgattgagtttgaagaaagttttcgctataggaaaatctttcgcaatgttatgaaggttacgcccggaaaattagagcacaaacttttttcttttattgaaaatttaagtgaaagttggtctacagctaatggaaaggcaagaattataaaacaaggattcgatatgtattgcatcgataaaaaaatcatttaagttactttaaaatatgtacaacagcatgagggatgacgaagaaactaaaggagaagtgatgaaaaagttaataattttatgtttgggtattatcggggtatttcttatagttcagtgtagtaaatttaacaacaatacaaaagtttatgtggatactcaattagaggtaaatcacgatgatgaaaatgaaagaaaaagttattatgacaatgattcaagccaagaaagtgaagcacttaatgacaaatatttaaacaaagaagagaataaggaatatgacatttacgcatatgatttaaaaactagggaaattcaatcacgtaatggacaacgtgaatatgtttatggaggcaacgtgatctctagcactcaagccgaaaaatatggttatcatacaacaccaattactaaggaaggagataaaacaatcaaattttggaggaacgatgtaaagtttgttcctgaaaagggtgagattgtcctggttagatttcctaagggtaatcataaaacatttgttgatattgagcttatgtataagccaacaggagagcctaatggagaatggaattggtgaacaaaaacactactttattttaaaacgggaatcgggctgcctacataagaacagcccttgcagttagctcgcaatccttgttttgactggtttgtttttcttgatattacgtaatttaagagcgggtttttccactattctgtacgaaagaaatgcggatgcagcagtaacagcaattagggctatgatcagcgggtaatcagacaatgttttattaattccagtgtataagaagatgttgatgatcaccatgtgccatatgaaaatccccatacttatatcgtctaaccggttcagctgtcgcaatatcttcggcccattgtaaccaaaccagacgagtgcatagctcagaggtacgaaccataaaaagctccataaggtgctgtttattgaactgagatgcagaaggtcaagtttatagaataaaaataaaattaccgaagacaaaaataaaacgatatgctgcggtaacttgctccatgccttagcccagaagatgcccaaagtgaaataaaacatctgcggcaggaaagaatgtaagtacaggttaccgaacacactgccaggcgcgaactttaaaattatgaaagagactaacacactgaaagcggaaacagcaaaagagcaaagaatcatttttgggaatccgaaacgtttataaaaccaataaattgcgggtaacaccaggtaaaagctaatctgaacaggaattgtccaaagtgaatcgttaaggcgacctgtgccgatgtgatggaatatgtcagggaagtattgagggtataacacaaaattgctaagaagccatgtccagtactctttagtagtgaatactgttaatgaaagagctcctagaacaattaacaggatggtggagacgatagcataggtgtatatagcgggtgcgatcctaataattcggctccaataaaaatcggttacattattacctttaagctgagatctctcataagaagtaaaaagaaaaaatgcacttagaaaaaagaagattgatatgccggtgtgaaatattgctttgctctctggggtataaccaaagacagaaatatttagatctcttgtagcatgaccaatcaacacacaaagagcagcaaacagcctgataacaaagaaacagttagaatgttttacgttcattaaaagaacctctttcctataccatatggcgaataagcagtaaggctgcctataagcagtgatgattatatcataaaaatggaagatttgttcttaaaaatgaactaaaataaatatttttgttcttaataaggtatatttgtgtgatgtagggaggtatagatacttataaatacacgtagatattcatagatacatgtatatctagctatatcaaggagaatgcagataaattaagaagcctctgcctgttctttcacctttatttccaatatagtataatttggaaaagggggagagggaatgaaaaagctaatctttttggctgtgatttgcattggttttatattgagttttaacacaccaagtgctgaggcgaagcttacattagactacaaaaatgtggattttcacatgagtgaggattcagagagtttttcaatggcagattattttgatcggaattttgatcgcacttggctcttctacaaattcacaattaacaatgctgaagggtgtactctaaatatgaaaatcagtaggataactcttgctggctgggtatttccacgtagtgagaagcagtttgtagggaactatgctgactatactgctacagatcgagtagagggagatgctaatcgtaatcatgtgttagagattacaaagaatccaggctgcggagatgtgtggattaaaggtatttatggatttgaacatgaagattcatttgattggtaagcttgatacatagtcaaggtatatccttgaccttttttatggatataatgataatttaaagtgatcatacataatgaatgcgaggtagtaacattgattaaatcaaatttaaagccaatattagacgaaaggaatatcagtattcgaaagctgtccaatgatattgatcatggttttaacacagtcaggaagctgtatcatgatgaaatggagcggtacccaagggatctgttggataaagtctgtacatatttagacattgagctgcatgagctgttgatttacaaaaaagattaaaaagatattgatcacttaaagtgatcatggtatactaaagttacaagaacagtaaatacttacaaattttataggtctacataaaatcgtactttcatagggaaaagaggaaaagaaatgttgccaacttctttaaaagcaaaagttcagcgaattttattaaaaggtagctttaaaaaatctgagagctctaaaagcagagtaaaaggactaagcaatatttcagcgggtttcacttttgagaagatgtttgacgacggttactgcctctattatacatgcggtaatatgactttccggggaatgccaaacgaaaaaaaggataatcaaacagaaaaaatgtatcacttcttattggatcagggtcttcaaaaaaatattgaattgacagagtttggaaataaaaaagtaatcttgttgaaagtggaataattgcgagacactttgaggagtagcataaatttgcactttacaacaaagggagagataaaatgagagaggaaattcaagtgttacttgaagaaattgaagaattagaaatggctttaagtaagtccgataacaatactgtttctgtggttcttcaagaggcaattgataaaagacgcaatgaaattggcgaactaaagccaaatgggtacgtcatagcagacgtagtccttaaagacggtaccgagttaaaacggtgcttagtttttactgtaacagatcgactagggtcacaagctgtaactgaattagttgaagcaagagaaatcttcgaaaaagataaagcggtttatttgcaacaggaatatgaggatggaaactttgcaggggatataggagtacacgaaatagcaacatacaaccttgaatatgaaaatggtgttaatgaataaaatcattctttcatcttaattaataaaggagagtacataatgtatagattcatatcagagctgaatttagacgactcgacaattcaaaggatggataaatcccaaagctttaaatacatcggtggtttttatatgtatgatccccagcaaatcgaatggccaatcccagaaggagaatcatcttcgctcagtgatttagcccatttaagttttaattcttatgactgtgaaaaccaaatgatcgcggatatgaaaagggaattcactgaagaaaagttgttaaatatttttaattctgagtgtccagaaacagcttttaatgacgctgcttcaagaatcattgaaaaatataattaaggtgggttttaattggctagagataaagaatgggttaaaataagcgaactttctgaagaagaaaaacaaagcttgactgccggtactgcagttctgctgcatgataattactataatgggtcgtcagaaaaagcttccttgataagaaaaaaaggttctcaaggaagactagaagacaagtattacgaattgaacggtcaaatggttagaattcttttcggaagcagaatcttaaaagtcccttcttctttattatctgttccagttgcaatcgacagggaacaggaagtcgaactaaatctttcaccagtccaaattgttaaagttatgaagtcattagaactgttactagacttagacaaggaagaatttaaatttaatcgagaagagattgtcctattattggagcagctaagtaagaatctagatagtaatggtattgatcctaacagagtaatgaacgagctgttttcaaggattgattaagttgaaatgaaaccagtcttttaaccagttatgtaagtcaggttgagtcaggaatacttttttgaagggttagatatcaaatgacgatgctaatagcagttaaattcgacaatagcatagtaatgactgctgacaaaagagtgactactacaaatagcttgggccgaattttaaaagtggaatcagatgaatataagaaaataaaaattattaataagaagtacgtaatttcttttgcaggtagaatgtttattgcagaaaaagcttttgattttattgatcaaaaaagcgatattttgaacagtaatattgatccactcttattttttagagaagcttttaattacggaaaatcatgttttgaagcatattattctggtattaacccactttccgtattttttgttggatatattaaaccagacgaaagaccacaattgttggggttttcatcagatgataattaccttggattagaaatcgattcaagtattaaaattaattctaactcccctgatcacgaagacatgcttataagcgaaactgttaattttatttcaacagaaatgtcaaaccgtcatgcctatcatgcaaatgaaagacttttagagatttattcggaggcaataaaaagaaccaatgatccaatgatcggaaaaacaacttactctgttatcttaacttctacaggtgccgaagaataccatcattaatgtaaaacagcacgtaaaaattataattaagtgaggagaatgtaaatgatcaaggtttatacaagaggtcataagataccaaaaaagattaaatcttgcatctctgaatgggattattggtcttggattgtagttaccaatattgcaaagaggaacaaggatgcgaaacgactaatagagaagattgaaactgatccagacaggattgcagaatataaaactgaagatggaattgaagtttatgtaagctacatgattccagtgaaatagaaaagagcattaaactaaatgctcttcttcataccacatctacgacactcacgtaaaaacacaccacttttcactgaactcttgaataaagcgtaatcacagttgtcacagcgaccatatttaacatcgggatactccttataatcatatacaactgttacatcgtagccattagtctcaaaatctttctcttccattaaatttcacctacacaaagtatttaacactactataataccagacgatgtatataaggagggttttaatttgattggaatagcatatttcttaatgctctggcttggtgtaggctttctgacaggatttaaggccttatttgttgatcaggtttatgatgaagagtttaagcaggaactgattgattcattttcaccaggtatggagcagaatatgattgaactgttctttaagaataaaataaatatcatggtgttttacatattaattggattgctgccactggccataaaaattgctggtctgctgaagaggagttagctatgcctgttatcgataccttttttgttattcaatttgaaaatgatgattacttcaagtcatttaaattagatggaagtggttataagacatctaagggacttcatggcgcttctaagttcattacaatgtcagaagctttaatgatagcaaacgagctgcgtacagagtttaatgtcacttctgccattagacaaatcgaagttattactaggtgatggggtgttcaggtgtactggattgaatggattgaggatggggagaagaaaagtattgttgtggacggctgggttgaatgggccacaatcctggaagacctttatcagcagcggtttgagtatgttgaatggaagcggctttaaaagtgttgacagaaataaaaatacaactgatgagacataagaacctgaaaagttactaggggcatttttttggacagcagaagtaagatgagatatatgccaattgaagattttccaaagaaagcttataaatacatggaagcgaaatggttgaaaaaattaatgagggacaagaaactttttgtaaatcaccttaataactatccagagtcaagcttaggtgcggatgttggagatgaccaagaaggtgtagcaaacagacatttaaacattaaaaaatataaaacaggagaccataatccacaccttcacaatgaactacaagaatggtttcctgactcaatagttagacttgaagatgtgtcatttcaaacctcaataataaataaaaatttttatgtttattgtttaactttcaattatgataaaaatattatgagaaagtttggaggttcagtaatggtaattaatgattttccaagtttcgcatattgggtacacaataaaatgaaaaaaagaaattgtgccttatatgctgcgaataattgcatatatagagattcaaggagcattacttttaatgaggaaaacactgatttttatttggtgccaggccttattaaagatagtaagcattctgaacaagaagagtttagatttctttggaggaaaaacgataattctttaataaacagaccaattaatgatctttatgtaccagaagcattaaagttttgctcctttgaaattaatgaataaaactttatattgtttttatggtttacatactacgttcaattatacgtattgaatttgcaaactttttaaatgtatttataatcttctttaaggagttgatttaaatgaattgggtatcttacccctcaattttacactatgctaatgatggtattacagtaaccttcccagaccttcctggttgtataacttgtggagaaaatgatacagaagcaattagcatggctaaagaagctttaggtcttcatttatacgggttggaaatggacggagagaagtatcctagtccctcaccgttttcggaaattaagacaggggaaaacgaagttgtgtgtttgattgatgtgcctatgcatgcatttcgtgatgagtataggcgtaaatcaattaagaaaacattaactattccggcttggttaaatgaagtggctgaagaaaagaacattaatttttcccaggtgctgcaggatgcattaaaagataaactaggactaaatatctttaaggcacagtaaggattcttattgtgccggttcatataaaatacgaattttaaacagataagggttccttaaaaaataattagaataaaaataaaataaatacttgtaattctgacaactctaatgtatattataaacaaagggaacattagttgggaaggggtgtagtaaccaatgaatcttaagcagatgattaagaatgaatgtgaaaaagacaaccagctcgcagcgaaactctcaaaaatagcagggtacaaaaaggttaatggtttttacaaattcatcaacaccccagagaaagaaatggacaacttaggcggtttaattaatattgttaaaagcttgtttcctgataatgaggagcagcttctaagtgattacttcttatcactggatcccaacaaaaaatgtgccagacaatctgttgaatactcagatattaatcaatgggatacgttaacagacaagatagtgtcgaggctatctagctcaaaaaacctagcaagtcaagaatggggcaatatatacagtatacatagaagattgagcgaaagtaagataagtttaactgatgcaataagagcaaccggaaagtgcaaaacagatgaaatgttatttttctcaaatgctatgctgatgtatgagtatttgaaggtaggcgaatttggattgatgaaaagcacattatcacttctcaatttcaacgacttacccgaaggctttgtgaaagattgctatatgaatagaatttcattattaaatgcaaatatttatttaaatgataatgaaattgaaaaatctaggtattattcagaacaagttattcaaaattcaaatataaatcgactaaaagtatttgggcatctaacatatgggaacacattaatttttgaaagctactctaaagccaaagagcagtatcttaaaggattggaatttgctcgtgataatgaacatcataaatataagctgcgattagctctttgctttttaagcaacctatggaataaggataataaatggcttgacttcgacactgataatatccctgataagattgaggtagcatattactatactaataataaggaatttaataaagcagagaaagtaataaatgagcttgagaatatggaattgtacgaatatgattctgggattctagattacattaaggggattctataccaaaataagaattatttttatgaaagcactgcaaagttgaaaaaatctggtgataaattatttatcaatcttccattagcggagctaaggaaaatgggctgtgacgaaaaactacttgaattaatcatggtctaaaattgaaggggggtgaattaaatgaaaaatattattcttggaatagtaatcttgttagcaatggctgttggatttgttgccggacagcaatcaattgagacagcatcggtagaccatgtagaccagcctgtaaaagttgcatcaccaagccgcggggcttaacttcaaagataatacataacttggctagacgtttgatccactggatcaggcgtcttttctaattttaagagaatgttccagaaattcataatataaaaaacaagaacatgggggaattaaaatgaaaaagcatttcggacaagtactttcttatgaggatatggctaaggggtacatggaaatgggagatattaatttagaaatttcccaggaagataatcatcttgaaaatgaagcagaaatggttagatcaaaatataaagcaaaggtatcctaatgaagattaaagacaaatcagcagacattttaacacatacataggggatgtgttatttgtcttgaataaaaataaaataaattgttgcatattattctagcaacatatataatgaagttacaagatgaacgttgttgggagatgaaacaatggaaacaaccagtgccactcaaaaggaagagttgaagattacatcattaagacaatatcaatacataaaacaactaaagaacttcacacgagtcaatctccacctagaggatccagatgtgtttacacctaataatgtaactacaatgagaaaaaatcataaagaatacaacctcattaaagaacaaaaaaattctataaaatgtatttaaggagtaaaaataaaatgaataataaatattatacagaagaaaacaaggctaaagtttggaaaaagcatatgatcgttttaaagtttctagagcagcctgagatagcagtagcttataatgagttcctacgaagagaagcgacaagtgatgaatgggttgggttcgaagaggagctttatgaggaattgacggggatgccaattataaacgtctgtaaggacgagagggtaaatgtcctaaactgaattttattataggataaaaataaattaggtgtgataaaatgaatgcagacatcttaattaacgctcttaaagaatacgacatgttaaagcaaatggaaatctgtaacgccaatataatgctgctgagtaatattcaaggtgagaatgaatggattgttgcgtggaaagaatttgatcaatacttaatgaaaaaaatgatatgaggtgtcattatggaagctcaaaagaaagcgtcaacactaagggattattcaatatacaataacataaataggtggtttgatgaattagatttaagaaacagggatcgagaaactggagaaattgaaaagtctaatactagagccacgtatgaaaggcatataagagagtttttcaaccactatgctgccaaggatattgaatatttaactgagagtgacctggcgattaagaagagtgacctgtatgattatcgaacccatttggctaaaaataaaagcaactccaattcaacaattaacaataagattgccgcactgaaaagtatgattaagtaccttgaatctgaacatgagtgtgatgcatctgtatttaattttagacctcttccaacagaaaagaacccagcaggctcttttgaaggaatatctgaagctgatgaatttgctgaggcagcgtatgttactgagcgtcagaacagattaatgaaaaagatgtttattttgtttagtgcacgtactggtggacgtaaatcagaggtacttagagttgggtgggatgatattacttattcagaaaagcaccaatgctatctcgtcaactttaaaaaaactaagcaaaaaaaggctagaccagttgggatttccactgctttttatgaagagttattgctgttaaagcaagagtatggggaacatgagcttttatttcataagttaacagttgattcaatacaggatatgtggaatcgcgtatgtagagttatgggcattcccaaagaaagaaagataactccgcatagtttacgcaatactgcaacaaacttttcttacagcattaatggtgatattaaaaaagtggcagcgttctctggccacagcaatatcaatactttaaatgaccattatttagtcaatgaaagggattattctcaagatccaggggttttggttgatcaaaaagaagacatgtcctttttagatgatgttaccttagagcaatataaagaattctttttaaaatcagacatgtatatacagaataaacttaaaatgtttttgaacaagtgatacaaataatcatataaaagctttacttgcttatgaaaataatgataaatttaatatgattatgtgaggtgataatgtgtctgaagttttgttgacaacggataaactttataagttaaaaactgaaatagagaaaaatcttaatgatattaaaaatgatcccaatatggtgaaggaattaaaagccacaatggcggacaaatacaaggcactccctggttatatccaagaaattttaaataataatgataacaacgtacagcgtttaaacgaaaaagaagtgtacattgtttcaaaagagttgtattcaattcttgggacgcaagctttagatccgtcaaattattttccaaccagattggcaaaagagcttgaaggtgggagagtattcgccggtgaagaagtagttaagctcccctacaagtttaaaaatgtgattaaaattaaagaggataactatgtcacttccattactgccaaagaactgagtgagttatataatagctccatcctgcagtacaattacaacactcagcgagaaggaaagtacattaagggcagccttattcctgtacctaaaacaaaccctaaatcagttgatgagatcaaagaattgtttattaaaggcgatttaattgtatcaatgttaacttttaacgctcgtcttggaacatctgatggtgatgaagaagttgaatatgattcaagcgaccaaaccctcactgtaacacgaggaaccttattagatgctcttgatggatatcatcgaatttcaggtattgttaaggccattgctgaagtccctgaattagatcaaccattcattttaaatgtgctcaattacgatgaagaaaaggctaaggttcactttgctcaaatgaatacaattaacccagttgaaaaatccagaattgaagaattgggtcaaaaacggtattcttcaaccgttgtcgagcagctgaaatttaaaagtgaacttaaaaataaaataagcccacaaagtgaaattgctattgatagcaattttcttgtaacatattatactttatccgaagctatagacgatgtatttgagttgaaatctcgaaaagatgcgttgaaaattgcgaaatacttggtagacttttttgataaccttttttatgcattcccagacgaatttcttgaagatgatttatcgtccattagaaagcaatcatacattaatcataacgtaatgttttacggttatgtttatttggccaagaagatgaaggaaaacaatgtagaactaaacaagcttgaaaatatccttaatacgattgactttagtaaaagcggaagagtgtttgaagaattaggaagacaaaataatgagaatcaactaaagaatattatgaagaagaaacttaagcgaatgttttatgatgaaattgctgttgtttaaagcctaaaggagaatttaatatgagtgaaatatataatgctgaattgaaggaaaagtttttagagaaatacgaaagtgaagcaacaagaaaccattattggctaaggctaagggatttctcagctacagaaaaaatacttcaaaaagacatatttaatttttctttggaagagctgcgtacgttatttttagatttagatagcaaatctatagattcactaagaggagcaagagctgtaattggacaatacacaacctgggcaatggaaaatggcttggcaaacagtaacatcaacaaagtgtatcagatacaggatggtgacttaaagcagtttatagataaaaacaaaaaaacactattcaccaataaagaagtagaagagtatgttgattttatggttaatgatcaggataaagcgatgatacaggctatttatgaaggcatagatggctatcagcattcagagttactgaatttaacaggtgacgatttacttgatgataacaaggtaaagctgatagatgataaacacggtgtaagaataattactgtaagcgataaatgttatgagttgcttaagcgtgctaatgatcaaacaacttatcatcttagcaatggttcgccagatagtggtcttaaaaacaaatttgctacattagttaaaagcaaaaacatttttaggctaaaatacaagagttctaatcagagtatgaaagctgacaagtttttagttcaccgatcttttagccagtttcaaaaatttttagaagaacccttcttttcacctaagaaccttatcaactcaggaaagctcaacatggcgtatgagatatacaaagagaagggtgaattaaaagtacctgattataaaaaaataactcgacaatacgggtttctgaatgaagacgcggagtttaattcacaatcactgaggaaagtagtgaatatggataacttagaaaaatattgtatcaagtctgaagtaattgagactaattcttaatccctgttgcagggattatctttacataacttttagagtaaaaataaaacatgtgcggataaactcgtgatattttttcgaaaaatatcaggattttgttcacatttttcagaattcgacaaagttagacagagacaaatttgtacatatgcagtaaaatagttctataccctaaaaagggtacaaggaggttcgctaggccaaactccctagcgataaagtcaatgtttgattttccattcatagagatcttcaattgaacagttaagggcaatagcaatgattttcgctgtttttatattcatagaaggtctaaagccgtttgcatagtcacttaatctttgcgtactaatgcctgttcgctttgaaagttctcctaatgacattcctttactttcgaggagaatggaaatcaaacattgtccgatttcaacctcaagcatcggacaacctcctgttatagtattgcttatcatactatatcaattctttccaagtttttaaatgaaagaaaaaagatttgccactaactaggtaaaaggttataattaagtcaacaaaaagggaacataagttcggttaattactaccagagagagggaaacgtatgtcagaaaaggattattttattcaaggggagctgtgcattcctttttttggcaggataaaagccaagaatgaagaggaagcactcttgttcgcatatcaatcaattaaaaagaaattaagaaacaaaacagggaaaatggggtttcttcaaaaagatcaagaaaaatatgaggcactatttgatgtagacatcatgtgtacagaggatgctgaaataacaacctcttatgccgaagaaatagacgattcgtttgaaaatgaaggctataaatcttctcaactgttatcaataaaataaaagcacatacacatcttgtcagtcatcatgagacataaaaaattggtgactttttagtcagactggagcatacaatggattttaatcttgaaattgacttgaaagacattatgagatcagtttccatgagtgttggttctaagaacatacaaagtggagagtactacatagacattatctttaaaaacaatggggattgtttgaggattagaatggatcatgcttcagttttagaatttagagacaaaataaatgaaactctttggaaactggacggcatgaagacgtttatgaagacagcagctttacagtatgagtaaagctgatttttttaaaattatttagaataaaaataaaataagtatttacaacatatggttgaggttatataatcgaattagaattaggaaaggagatagctttaattattgattaatgaaccaactaataatcaaataagaaccatggttttaaagaaatatgcaaagctcttagcgtcatgtgaaaggtcattgcgcagcatagagaataacgaaataagaatggcaattggagacctagattttgttaaagacaatttagaggaaatacaatacatactccgtgatgttgtgaatcagcatgaatgtattaagagtaaaaataaaatttaagttttatagagattaagataagggggaataacatgggtgcattaatcgctaagcaaccgaatggacggtactgccgatttagttcagtggtagactgtccaacgcacataaatatgacgcgtgaagactatttaaataattttactgggacaacaaaaggaagggaagatgctgaagatacacttgcaaattatctccggccgtttcacgaagttataaagtggtacacaccgctgaacatgagcgaaaaagagtttgtggaggcgttaaaagaaatgtgtgacgaaaacccaaaggaggcgcgggaattgtgaacacagcatacagggtgtgggacggcgagcagatgcattattgggatgatgaagggttgagccttaccatcaaaaataacggtgattggactttgaaacgtttatacacagatgttttggttcccgttgtagacagcacgaatagaaacgcggctctcatgtggggcacagggttgaaggataaaaacgaaaaaatgatttacgagaaggacgtcataaagtttaaatctgtctattgcgaaaacaagattataaaagcagtggtcaagtttagagattctcttgggtcgtttgtattcaataggggagacgatcaagacttttggagaatggacgtatccctaagtgaaatcgaagtcatcggagacatttatcaaaatcctgagttattggagggcgcggagtgaatgctgaagtaaagcgtgttgaatataagctgtggtacgaagttaagtacggatggaagcatctcagtttcggcgccaatgatgataaaactgcattggaatacgcagaggaatacgcaaaaaataactacctcataaattataaggtggaaaaaataacgaatgagagattgttttggactgaggagggcgcggaatgagtaagaggtctaccctgttattaaggaatagtgtgaaagcaggacaaagagaaaaattcattacaaatggcattccctatgatgaacttgatacacaaatgatcaatttaattgatattttgaatttcatgattggattgaaaacacgccactgttgttttggacataaaccatatgaggaaattcaagtaatgtttgaagaagaagtaaatttaaaagaagatcaaattctagagttagcggaattagcagggagagaatggaaaggtcttcagttaagctttagcaaatgggcgagattttctccattgatgtttaattggtcattggtactatcgaaaagatttagagatccagaagatccaaataaaaaccgttagctaagatcagttgaagaattctttgagagctatgctgcaaagaagtgattaaaagatgcattttaaacaaataaaaatcagaaaggttgatagaatttgagaacattagtgttattaagaggctgcccaggagtggggaaatcaacttggatcaaagataatggacttgagcaatacacactttctgcggacaacattaggctactgtttcagtcacctgtgttaaacaaaagtggaaaatatgaaatctctccgaaacacgataacaaagtgtgggatttattaatgaaattgcttgaagacaggatggatcgcggcgaattcacaattgtcgatgcaactcattcaaaacaaagtatgatttcaagatataagccactagctcaaaaatatagataccgtgtacatgtagttgatttttctgatgttgatgttcggagaatcttaaaaagaaataaaatgagggctgaacataaacatgttcctgagagtagtattctaaatatttatgaaagaatgacaacagaaaaagtgccatcttgggtaactgttctaaaaccagatgagttcgaaaacacgatgacttataagccaagatgttttgacgattataaaaagatccatatttttggagatattcatggctgcaatactgtgcttcaagagtacttaaacggtgatttaaatgaaaatgaactatacatctttgtaggagatcttatcgacagaggtattgaaaatgcacagctgttagaattcatgatcaaaattaaagattataaaaatgtgattattctggaaggaaatcacgatagatatatcaatatgtatgggaatgatgaagaaacacctagcaccacatttaacaacaaaactaaacctgaaatcgaacaatccaacattgataaaaaagacattagacagttggccaggaagtttcatcagttagcttactttacatataaaaacactacatacattgtaactcatggaggagtttcaaccgtacctgaaaatctcttgatgaccgcaacaacacaattcatcaatggagttggagattattcagacgatattgattatgaatttgcaaataatactgcaggtcaaaatgttgtacagattcatggacatagaaacatgtaccgtctgcctgtgttagcagcagaaagatcatataacttagaagggcaagtggaaagaggaggtcatcttagagtcgttacactgtctgagaacggaattgaaacgcatgaagtgaagaataaagtctttaaacaaatttcaagtgaagtacagagtaacagtgcaactgttggaacaattgatgaattgatttcacacttacgtggtcatgaatatgtgcaagagaataagatgccaaacaatatctcttcatttaattttacaaagcaagcatttagaaagaaaaagtgggatgaaacaaatattaaggcaaggggattgtttattaatactgagagcaatgaaattgtaagcagaagctatgataagttctttaacattggggaacggtctgaaacaagaatgcatcatctcgtggatacaatgaagtttccagtaacagtcttcgataaggcgaatggatatttaggaactgtagggtatgactctttgtcagatcagttggtattcacttctaaatcctttacgtctcaattaacaagtgaacatgcaaaatgggttgaagatatgtttttcaagtcctttgatgaatttaaagtaaatatcattaaagattatctgaagctaaataatgtttcattcgtttttgaagtaacacttccagaaaaagatccgcatatcattgaatacagtaaagacaaactagtcctattagacatcgtaaaaaggcaaatgacgtatgaaaaactcccttatagtgaagtgaaggcagttgcagagagtctttccattgagtgcaaaaatcaagttgcagagtttagtaactggacagatttctatagatggtatctggacgtgtcacaagacttttcaattgaggaagagggttatgtaattgaagatgatgccggcttcatgacaaaacttaagctcccttactataacttttggaaacaaatgaggggattaaagcataagatcagcaacaaacatgagcatacggttaatacaggaagcctttacactcctttgcataatagattttttgcatgggctaagacaaaggacagaggatatctaaagtcaacctccattatcaagttgagaaatgattttgaaaaagaaactgtggtaatggaatccagatgaattcaagataaaagtaaaattttaaagagaaaggttgatgggaagatgaaatttgcaccaatggataaagttaaatttaaaacagctagccatttcaacaaacttcgaacatttaaaaaaagagttcctgaatttgacgatcctttactcggtgattgctgggaatttgaagaagatgggttaaaacaatttgattgggaggagaattacgaatttgtcgctaggcccaaacattttaattgggattaaaaataggatctaattgagtttttaatgaaaaggagctgttataaagtgaaagatatccgagttgtttatgacagaaacaaaactttagaagcggtcgttgtccagtttggagctatatgtgtgagctagtagaatcgcaattaattgatgaagaaactaaagaattcgacgtacttaatgatgaatatcaaggaatttggaaatatgaaaaagggcaacactgcgaagtcgaaatttatgatggggtagacaagtgggtttgtcaagcattattaaactgaataaaaagtaaaatgttcttcagatgatataaaggaggggaaataaagatgagggaatcacaattaagggaagaaaatgaaaatttgaaaaggcaagtagatcatatgaaagaagtctataaagaaaatatgcatcttcatatggcagtaagacaaggtgaacagttaaaagctaacctacaagcttatttacgacaagatgaccgagtatatagtccccatttcattacaccaaaacaaaaacaatatatcgcaaatttgttcaaaaaacatggcttgtctccactcagtaaagcaaaacgaaaaatagttaggcgttttaatgggggcggtctgctttcagagcacgaagcacatcaaattatacaaatgtatgaaagaaagtaatgttaatcttgacttggctggttcaactgtaaacaagaaggaaagagatttttaattgtagttatacagtcacaataaaaagactgttttaaagaaagggtgagaaccgatagtcactttcaaaaaacttagtgatcctgaatatattaagcagatggaaattgaaagaaatgaacgtgagcggatatatcaaaaaaaggagactttaagaaagaaaacggtgtgcttcactggtcataggccgaacaaattgggtggatacgatatgaaaaatccaacaatgcttaaactcaaagataagctgcttgaagtaattgaagaattaatcactaaggaaaacaagtccagtttcataactggtggagtgttaggaactgatcaggctgcttgctggtgtgtacatattctaaagaagaaatacccacatattaaaaacataattgcaacacctttcaaagaacaagataaagtgtggtctgaagaacaaaaaatgtggtacaaacgtatgcttgatgtggcagatgagattattaatgttgaagaattagataaatataaagttagtggagctgtaccaggtgagttttcaccggctaaaatgcaaaaacgaaatgaatacatgattgatcacagtgaagcaatagtagctgtttatgacggaagtataagtgggacaaggaactgtctgaattacgctaggaaaacatacttaggacatcaaatttggaggctgcatccgaaatgtgattttgaattggatataagctatacgcctgaatgaggagggatataacatgagtgaatttaaaattgtgaatttagatggagttaattggggatcgcataatgacgacacgttagatttcaaagaattgattacaggaggaacgattgcagtaggcgacgttgttaaagttgaaggacggggcgattgcccacttcctctaagggagaaccaactttgcataacatttaacaaagaaaatgagttgtttcttgaagaaccattcacccaagaagaatgcaaatcattattcggatcagattttagctactaagcaattactttaaaaggattatttcaatgaaatgaggtgggaatttgagtgagaactataaagatccgagacaagttgcgcttgagcttgtaaagaaagcaagtgatcagattcgctataccaatgatgatgaatttacatttgaagtggttgataaattggaggaaattgaggatatgcttaagaaagatattgataaagaaaagaagaattcattgaaaaattagttgaaaggatgtcgttagcataggatacatcaaatacataattgatacagcctggtttaacttagtttggtttaagtggcatcttggagcggatataagcatatttgatggctgcggatggaatacatataaatatttaaagggtaaaaataaaataagtggaggttataaagatgataaagaggaatctgcttagcaaccacgttgatgagattattggtgaatattacgctgctaaaggatattcagtccatagcattgaccgccaggaaaatggacaactgatcgttgttacagagcgagtagcagaggagaaggaaccggcacaagtcgatattgcgtttgattttgtacatagaagaccacataagaagaagtatttagcttaaaaacggcaaagagtcaaagctctttaccatcaggtgatttctttaaccgattcgcaatgtacttcattacgtttactgcaatcgacactaatgcaataatcaatgctatttcaaataagaggatgtatccaaaattcacattaagcttttcaaagtaatcgctggtaatagagaggattttataaatccctagcataaaaacaataaaggaaacacctaaaattacaagtgactttatagaataatctttagtatgttcaaaattatagataattattgatacaaataacaaacccgtagcaatcttttgggttagcgaatcatcggccgaaaatgattgcactactatgctgatgattaatccagcaataccgattgttttattcaaggaatcacccactcgtatgtaagttaggtatgagtttaccaattaaaggggattttctcaaggcaatacacattaaagttaaattaaaatgctttttaagaaaggggtggaaacatgcttggttatcagaaagggcagcaagtaagatggcatgaaaatggggaaatgggaattatattgtgggtgacaaatcaaggctctgtaggtgttaaatggagctcgggtgaatacggtgaatacaattataaagttgatgagttattactgttaacagattagtatcttacccaaaagtgtgaacgcatgacagcaagaaaaaggtttagtctacataaaatcgtgattttaaacagaataggaggaaacgaatgaatcaagatattcagtttttaaaagaacttcagcaagagttgaaaaatcaagacaacgacggacaagctgcaccacgtttctggacagttggtgattatgaatgggtcgaagctcgagaggaaaatgcagaacggtattctgtatacctgccatatattgcagaagcatatgttttagatgattatttggaagatttaaaagaagatagtgagctatctaaggaagcattaacagagttgaaaaatgacgactttgatgatcctattgagtggattcaaaaatacattgatgaagaagcagaattaattccagaaagaaaggttcatattgtacggccggatacaatgtttttgaccaaagaagaagcgaagagccacatcaatttgaacaagcatcactacacttcagaagctcatacttatgcaatgacagcttggagggcaccaaaagtagagcagttgcttaacatacttgaaacgtttgattggaattcaattaaagacagtcaatacaatctataaggggtgggaaaatgaatacatatgtagttacaaaagaaactgaaaattatctatatgaaataaataaacaaattgtttatgccggtaataataaagatgctgcctttggtcataaacctgaaacaagtgagagcagactaattttagacgtctggtttaatggcctaattgttaaatcattcagcagaaatcctaatggaaactggcgcgttttatttgataaaatggcaatcgcgaagaaagaagttgaagactacagcagaaaattaaacaaggcacaagagcttgtagagatgatagagagagctgaacaagtctagataaaagataatttttaatcagttattaggaggaaacgaaatgaacgtaaatattaaacggttatcaccggacgcacagattccggcttatgcgcacgcaacggacgccggcttcgatttagtggcgtcagaggacgttattatcgaaccgggctgggcagagcttgtgccgacgggtttggcgttcgagattccggagggatacgaaatgcaaatccgtccgcgatcaggcattacgctgaatactagactgcgtgtgcaactcggaacagttgattcgggctatcgaggagaggtcggagtaatcgtcgacaatataaatcgttatacagatattgaaaaggactttcttttcgatatcagagataaaatcgtcagtgctctcgattacctcggagcttgggatcattttgcgaaaggttcgtacatcatccgaaaaggcgatcgcatcgcgcaagccgttatcaagccggtcgagcaggtggtatttacggaagtcattacgctcggcgatagcgatcagaatacgagtcagttaatttaaagtctgaatcgacgcttttcctcaaagtcttcgggatactcattctgctttgacttggacttgaatacaaaccaaattatagcacctagtgaataatccatgactttatcaaaaatccaagttgtgaagagatccataagaattttcattgcatttcacctcccgagacaaaaatgtcctatctctcttagatggcatgtgtatgacacgcatctattaataaaagagtgaaaagtaatatgaaaatcaaaaaagaattgaaaaaaataaaaaagaggtgaaaaaatgatcaaacaagaacgagaagattatataagcaggcttgatgaatatggattgacagaagaaggggatgagggaatgacgaatattttgaatgattttgtaggctatgacatttggtgattatttatgaataaaaataaaatagttatttatagaagggaagggcgcagatggcaacagcagagcaattgaaacgaatgaacgacataaacgatttgatcaagcttatcgcaagtattgatagatgtactttctactgtaagtcaaagaatcggatagcgtatttcagatttaagaaaaaactgttcttcgttgatgattacacgggcgctgacgtttacccatatgaattgggatacgggcgtgcaaatggtttttcgcatgggggcaacatgtggcaactagtcaacagcttcagaaaattcatcataacagggaaatacggcgagctgagggattataaagaaatatgggcttacagctatgaaggttgtatgaaaatccgtcagaaggcgaaggagatcggtttcattgaaagtgttgattacccctacagctttgctgaatgggcaagttaaactaattgattcatgtactaaattttcatcaaaattaattaactttgagctaaggaattatgtaacggagagattagactctccaggattcaaaggaaggtatgcggagtttaccatgcttagtcttaaatctgtgcttaaccttacataagatcggttctacaaatatatattcgtcagtttcagactttacatgtttcatagagtggaatttacttcgttctgcgttcggcatgaattccattattccggctgcagtaccatcaggataagacagaagaaattttatatcctctttggtgtagccggtgataagcacatctgtgtaatcataattaatcactttcagccagctatgggaacgtttattgatttcataaggggagttagctttctttagtacgattccttcaagatgcttttctttggccagattaaagtaagctaatccgtttccttgtagaccttcgattacaaatacattatcatggtcaaggtttaggtctgaaagcatactcttacgttcagtgagtggcttagtagcgattgaatgaccatcaatataaactacatcgaatacacagtaaaccaccttatgagctgatttcttagacataaagcgttccataacagcttcgaaatctggagcaccgcctggggcagctacaatgatttcaccatctaaaacagttccattgggtatattaagatctaacagttctgggaacttgcttgttacttcgttgttgtgacgagtataaagctttatctgatcattaaacttggagaggatcagtctaattccatcaaacttcagctcggtaatataatcatcgtcatcaaatggttctttgattgaatgcaataacattggcgatacaaacaaaatatcacctcctacttagaacataatagctaagcgaaggtgatatataaagcaaaatgactgtggtacttaatgggattcaatcagttccggtgagttgtttttaggcgagttaactaaggatgaaacttgataagcttccatgtcatcagcatcatacggaagcagtaagctttgaagataatcaggatcggtgtttttggggtttagccattccttttcgttcttgtcagtaagaatgaccggcatccgatcatggatgtcctccatcaactcattgggttttgtagtaatgattgtgcaggtatatagcggattgccttctggcgtattccacttttcatataagccggcaaatgcaaagaggttggatgatttaagtttaatcctcataggaaccttagtctttgggtcaagacgcttccattcataaaaactgtccgcagggatgatgcaacgtttgctaacaagcggttttctgaagcaaagtttctcggccaatgtttcagctcgagcattgatcattttatagccgatcttttcatctttagcccaaggagggataagaccccatcttagcttacccagacggttgtttgatccatcattaatgattgtcaggatgttctgtgaaggagctacattataacttggatggtatgcgtcttcagacaaaaattgatctatattgaactgttcgatgatgtcgtcaaactcagaaaataaagtgaacctgccacacatgttcatcatcctttagggttttttgaatattgtacaggcttgatacacgaaaatcaaaaaggaggaatgtgatgcagcggcaaacagttgaggtaaaagaagttgtagtgttgatcagagggatatggacaaagaagaagttcacggatattgaaaaggggcaaacctttaagattgtggagaatggaagagtaaagaaatacatagcaagaacagatccttattgggatgagatgtacgaagcctacataattgatttatttgataaaaataaaataagtggatgtgagaataatggcgatcaatttaaagattagaaagaacaaagcagataagccaaaggtgaaagatttagaggacgggtacttcattaaaatagatgatgctgatgtatacattgttagaacactagacagagagtatgccgctaaagataaacatgaagttattcttatcgatctgagcaccttgcaaatagcgccatacaaggatatgaaggaattaaaaagtaggctgtctaacagaggtagcacagttgaagttatcagacctaaacaagcaaacgttaatatcggttttgagtggagacaataaaaggaggtggagagaatgagagatattaaatttcaggcgttggtagttaaacatacattaagcaatttgggttctaatatgcattgggcaggtatagacagttacgaagaaattattgatgttcatgacatttcttttgataacggaaaaatagattacgttacagataaagacggtgatgaattttcgtttgctgataaaagtttgaaatcggttcgacaatacaccggattgaaggacaataacggcaaggagatttatgaaggggatataattcggattactttcgacaccacatgggctgaagaaccttattacgttggagaagttaaattcttggatagcgaaaactatccagcatttgatttaaggccttggattgattgtgagatgaatgctttgagttggttaaaaagcgaatcagacccgactgtcatcagttatgaagtaatcggtaatatttacgaagatactgagcttttcgaatctaaataaaacagagattttataaggataaaaataaaattaaaaaggggaaatttgatgaagctaattggtattaaaacaagtaactgttttttggtgtctgacaatattgaaggaaagaaatattttcatagtcaattagatgaattgtttttcgatgggaaacgagcaactgaaacgtataaatcagactggtttaagcttgataaggagccaagtgttattgaaaaacaaatgcctgctaaaaaaatcaatcataggtatgaattaaaagaggggttccaggaaactgatttgacgccacaagtaattaaaacttcttacataggtgaagacagtgaatactatgaagtgaagggtctatataatttaaaatttgaagaagtcccgcaacagaatcaaaaaattgagtttgaaatgaatgtaattgaagaaattgacggagaacttaagttgcaaagccataattttaacttgaattataacttactggatagaattcaaactcatccaatgcttcttgaaacaaagccgtgttacttgtcccgagaagaaagctataagattatcagaaaccatataaaagccaatataaaccctaagtttgcaagaatcacgagtgattatgatttctgtttaactgtggtcaaagttttggagctttgcaaacctcaagagtacgtagttgatctaaatacaatgtacaaacgtagaaagcctaaacttgagaaaagatttcaaacaaagcgggaagttgaaatttacaatgttgcacctaaagcctatcagagctacccaattgtagaaccgtttagtggcaaagatgttgaggatttaaagggcaatattaagaaatttctagatgatctaatggataaaattaatgagcctttagtcgaatgtaaatgctgcgaaggaagaggggttatcttaagtgaaaattaaattggacaaagattacatggtaaatgaattgcggctgcctgaatcctcaattttagaagaaatcactgatacgtctaggtggagtattcattatcgtattgtgtttgcatatcaagacaagttttatgagacaacttacagggaaggcgctacagagttacaagaggagagaccatgggaatacgatgaccaggttgagtgttttgaagttgagcttaaggaagttaaggttagaaaatgggtaagaaaagaatctaaataataaatggaggcggaagaatgagagaaatcaagtttcgaggaatgggcatcaacggagaatggtattacggcaatttatcaatcattaagcaaagaatcaagagtatgggtattgatcctggttcttatatctctaataaagctggtgttccatttgcttacagtgtcaggccggaaacagttgggcaatacaccggattaaaagacaaaaacggccgagagatttatgagggggatattttaaaaagaacagtcacggttgtcatgtacggttcaggcaaaccacctaaagatattgatgaatacttagaagttgagtatcgggaagattatgcgggcttctatatcggagaaaggccactgtttgcttatgtggacaatactcgtgatgtcgatactggctgcagatgcagcaaagcagaagtcatcggcaacatttacgaagatcctgagcttatagagtctaaataaaaacgatatttaaccagatagggagatgtttaaatgacttcagaagaagcaagaaattattttgtgcaaaagggacttagttatgaagacattacggagggagatatttgtgctttagttatgctactcaataagcatgttaaacaggcagttaaagcacatacaatgtctgttgatacaatgagaatgagtcagaaaataaaaagcaaatacaaaacaaatggaactttaaaaagttgttatctttacataaacagtcactattttactcaaagagaagcaattagttttaatccagatggttttattggtttcgcagggtgggcagattcaggcaatagacaacctataattagtgcttttactgaatgggttgattatatgagtgaacagttaagacaaatcagttaaaagtaattttttatttaagggggtgataacgatgtgatcgatttatatgatttgagttttaaaaataaaacaaaaataaaaaggagtggttattaattgttgaggattaaaaacaaaatagaggaattgctaaaaaagactaaaggagcagaaaagagagactttggacggtacactctaatctgcacacttcgcaaggttacgaagctattaaagtatatcacagaaaagaagtcttttccagtattggtgacagcattggtttcgttcatgaatccaatcagtatcttagcagcggacaagtatcggaactttgaagagcttaaagcgaatgaatcaccgttcaattttagcgtgttctcaaaagagcaagacactgatgtattaattcttgctccccatggaggtggcatagaagggggaacaagcgagcttgcaaaggaattaagcgaaacatactctacatatctttttgaagctttaaagacaccaggagcctttgatttgcatttaaccagtacgaattttgatgaaccacaagcacttgaaatgttgaaggggcatgagttcacattgtcacttcacggttatgcaagtaatgatcaacatgttctagttggcggcacagaccgggacaaagctgaagcgataacaagtacattaaataatgccggctactctgcagagcttctagatgagggtacgaggctatccggtagcagtccaaataacgtggccaataaaaataaaacaggaaagagcattcaactggaattgagcactggactacgcaaatcaatgttcaacaccttttctctgaaaggacgctctggtacaagaaatgagactttttataacttcattgacactctatcagggtttctcaatgaaaatgtagaagggaagggtttgacaacatgaacatgcaacagcccttatactattttgttgatgctctggattggggaattgatgataaagggtcaaatgcaattgaaacaacagaaggattaaaccgagctttagagtatgcatgctcaaaatcattctataaagtatatgttccaaaaggtatctacctaattgatgcagtgaatacgtcaaagcggttacctgaattcggtggaggtatcaatgttccttcgaatattgagctaatacttcatccagaggctatatttaaagtgcagccaaatgattatcagggttactcctgtttttatatcggccaagcaagtaatgttacgattcgtggcggtcaaattattggggatcgacatgagcatgattattcaaaaattacctcaattaagaagacgcatgaatggggctttggtatccatgttaatggaagtagcaatgtgctaattgaaaatgtacaagtttctgactgtattggagacaacatttggatagcggctgatggaatgatgaacacttcaggaacatatacgccttcaaagaatgtaaccgttcgaaagtgtacgcttttaagaggaagaagaaataatctggctaccaatggttgtgaaggtcttcttgtcgatgactgtgatatagaggaagctggaggagatacaattgggccacaattaggaattgatttagagggctttggagaaaacggaattaaatacgatcacccgtataaattaactgtgcgaaactgcagatttaaaaacaatggacgtggatctgttacagctcacacaagcggcaaggtaattattgaaggaaactacagcgaccatgttatttcctatggatatagcacggatgtcagtatcaaaaataacaagatcatcaatgaaaatgaaattaagacttatggaattgactcggtaggtgtttcaagtactgagtctggaaacagagttcaaattgatggcaatacgattagtggctttgaagtgggcatttgtgtaagaggaaagggtggcacagtatcaaataatacttttgaaaaaataaaagcatgccctattgcaacacatcaagcagaggactttttaattacggacaacaggatagaaaacagtgattgtgttcaagtccaggttagaaactcaaatgatattaaggttgtgaataccaaaggaaaaggaacgagctcgtcttatgctgcaaagataatggactctacccgaatcagtctcgttaataatgagtttgctaatgtatatggtggaatttattgcgaaaggtctcagtcagttcgtttaaagggaaatgacttgttgttaagtgggagtggatacggcatcttttgggataaagactcttctgtctcactgcatcgaaatgaaattcatgagcctaggaatgttgcaattaaaggcacccctgagaaatacagttgccagattagtgagaatcaggtttatttctgtaaatcattaatcgccatccaactgactggtggttcagaacatatattaaaggataatgagatcatgttcaatcgttcagcagaccaaggatatggtgtttatttggagaatacaaacaaggtacgtctcgtaagaaacgatgtgcgcggaattggtggcaagttattatcccacccatattgcacagataaagcaaagaatacaaccttaatttataacacatatgacagtggaacactgaagactgcagaaggagatattgtggtctaaataaaactgtagttttaacaagtttaggagatggatatatggccaatattttaaccaaagaacaagatgaagcaatccggtatttcaagaacaagctgaacatatctgaaaaactgtacatatccctgattaattttaatctgcttagagataaacacgaagactttggtaatagactatatgagctttataagacagacccttatctgtatatcagagcgcttaaagaaggttatgtggttgatcagccaattgaatttaatgaagcaattgtgcggttctatgatggtgaagaacttgctgtgatccataagactactgggaagagatacaatgtgaatgttaaaatgaaaaagcttcctgatgggtttacgctgcaaacaatgaacatgtggtcttggagtgaggttatttgattattcaaactcctttgtaaatggtataattgaattaataaaggagtggtattatgtccatcaattctattggaggctgagtcatgggagttagagtgggaggctaataagataaacattttgagttgctatttaagcggctcttcttttatgaggtattctaaaaaatatcgtcgataaaggagaaactgatgaatttcttaacagcaaaaaacgagtacggtgaaacggtttactttaaaactcttaatagaaggcctcgattgggtgattttgtgaaaccaatcgatacacgacctgtagacattgatggcaatagaattaaagaaagtggcaatagcgcaaataaatatgatgatctagatatcaactctttttatgaagtatacaggatatttaatgttaagcatgtaatcattaaagataaactcggtcataaagttcaattagattcaagtcaataccaattagcaaagaaaatcactaaagaggaatatacgaattttaatgaaaaacttcatttattaaaacatattgataacaaccttaaaaggattagcaacttttccagctaaataaaagcactttgtcgagctgcagatagtagctcaactctttttaaaacttttgagaataaaaataaaatagttattgaccgatccgttttggtgatgtaagattaagttatcccaaagagagaaaggaggaaagagatgaaaaaggaattaaagatactgaaagtatctgtcgaagccttacatacctacaaaaatgatgtcaaaaggaattacgacattgacgaagaccaagcaagaagaaagttaaccaggaatgtgatgttggtaaaggaatttaaaccaagaggaattaaaagaggtcttttttctaaaacatactcatatggaaacttaaagatcacaattcgacatggaacagtaataaggattgaaaatgtaaaaggtgatcctgaaccttgggactttccaaaaaagagatacatagaattaaacaagctacttggtatcaaggattgtaagtttagtagcaagtctcattataggcattttaagaataaaaataaaatataatattaacggaggcgttatattgagcaaactttataatacatttgaatttatcggtaacctatttatttcaaacaataaagagaaattccatgaaattaaggaatatgacagcggatgggttaaggaaagattaagcttcgcagttcaagagtcaaaaacaaacagtgtttttgttgagattgaaggtggttactcaaaaagcaaacaaaataaagtgttttcattcagcaagggtacagaaaatgaaaaaggatcaagactcgaaattccatgggaagatcggttgaaagaagaaacagtaaacatggttgctgatttttctaagatcctaattaacttaaacgatgagtcaacaaaaaccaaattaaatgaattgaagtttaaaattagagggttggaaatgaaagactctcttactgaagaagaaaataaaactttatctactctcaagggagaatataaacaattaaacataaacggtgcagaattcattcatgaatacgatgctattcagtacttatcccaaaatctcgaaaagcataaagacaataaatttaaaattacaggtaatattgaatacaattcatggaatggacggaattttagaaagttcaaaatcaaaaccattgaaattgtaagtagtgatacaccatctcaactaagagccacaatggatgtatttttcacaagtgaatctttagatgaatcgtcatttgaagaagaaaaaaggtactttgttgatgcatatgtgcttagctatgataatcaggcaaaaaaagatcgattttttcctcagcaattagtcattaatgcacaaaaattggactttgaaaatgatttacatatgaaacgattaaatctcttgaaaaacttctttaaagttgaaaatgatgaagtatatcaccttcaatgggttgtgaatattttcaggggtgctgatgagattgagtttaccgaagaggaactcacggaaagtcaaaaggaaatgattgctttaggtttaaacacactagatgactttaaacctaaaggagggctattgggcgaaaatcgtgaagaaaatagacttttaaaacctattttaaaaaagattaatgattctaatgattttacagaaggtgctgcaacatctacatatgaaattgaagatcttacatatattccacaacagattcaaaattctacaccacccgtagaaaaagaagaacctaaagtgactgaagaagaaaaagataatgcatttgatgatttatttgcttgatttgaaaagacctaactgacatttatttaaaaacaataaggagatgtttatccatatggcaagaaaatttggtaaaaagaataaaattaaagttaatcctctcgattataacactggaattattggtgaatcggggatcggtaaaacaactttagctaaagaagtttgcgaagaattagtcggagcagatgggtatataatcttgaatattggtaaagaggatggcatcgatgccatcccaaatgcctcctatgaagatgttcctgattggacaacctttaatgaaattactaaagatattattaaaaacagaacaacagattatgcagatttaaaggttttagtatatgacacatttgatgagttaattaaaattacagaaccagaagttattcgactacataataaagctaatcctgaaaaaagagtgaatacaattaaagcagcgtttggtggtttccaggcaggagaagacaaagttattgagttaattcttgagaagatgtgggaacttaaaaaggtcggtattagcatgtttattttaggtcatacgaagaaaagaacaatgacagacgtagttacgggtttggaatacgacatgctgacaaccaatatgacacataaatacttcaatgcgattaaaaccaagctgcacgttttaggagtagcatctattaatcggtcgattgaaaagaaaacagtaaaacaaaaaattgggcctgacaaaacagtgggaacagttgttgatgaatcaagaatcatcacttttagagatgacaactttaatattgattcaaagtcaagattctccgatatcacaccatcaattccattagatccgaatgaatttattaaagcaattgaacaagctatccatgtggcttttgataaacaaaaaaataatacaaataacattgaagaagaaagaaaagaacaagagcaaattaaagaaattcaaattcacaacgaagttaacaactcatcttttattgataaagaagagaatgagaggttggccgaagagattaagacactattccctaatgcaactgccgaagctaagggtgaaatgaagaaaattatggatcaatttaatatgaaagattttaaaggtgtagacattgtaccaactacagcattcgagaagatagtcgaagcattatctaactgaaggaaaagagggggagtctcccccttatcaataggagagggtattcttggccagaagatgtgtatgtcaaatatgtaaagctaatggaactgttgatacttttttcagggtttctgatgataaggggaaaaataaatactactgtactaaggatgaatatgaaacctatatcaatgataaggtgaaacgaaaaaacctcttaaactacatagcgaaagatgtcttgaattatagagagggtcaagtcattcctccaatttttctaaaaaagatagctgaactaaaaagattttatgattatgaagtgatacaaatttgctttgagaagaaccaacaaacaattcaatattggttaactaataaagagttttacaacgagtatgggatgattagctatatttttaagattgttgaaagtaacatcaatgatgtttataaggaatggctgcatgaacaaaatcagagaatgattgaaaaaaatcataatcttgatattgcaattgtaaatcaaactaatatcgttgattccacatctttaaaacaaaacaattcaccaaaaaatataacagagtttctggatggggaggacgagtattgaacaacttagattcttatccaaaggaattagttgaaaacaggggacaaattgaaggaagctttatattttgtttatggaaaaaccctgatttgtatgaggattataaagaccacgtgagggcggatagagattttctaacagaagacgggaaattttattactctctaggtttagaactgagcaacatgaattataagagctttgatgatgcgagtgttttcagctacatagaaggtaaagaaacattaaaaaatggttttattcggcgaggtggaatgaaaaccattgatgaactcaagcacgtactaaacgatgaaaatgttgagacatactatgatgaactaattaaatttaacatgatactaaagcttcatgataagggattcaatgtttcgaacgagcttgataaattcaagaagatgacgagtcaacaattgtacagttactttgaatttcaattagataatgtttttctaggtcgcggttcaggagtgaaaattgaggatcttgatttgaatgaagagtttgtcgaatcaattgaaaacggggaagaaatgggattaagctattcagctgcatgtccattattgaattatcacacgcttggacttcataaatctaatgttcaaatttttgctggatttagtgggacagggaaaacaagtttttgtgtttcttcttatatcatgtcaattttagatcagggtgaaaaggtaacaattatcgccaatgaaatgaataaaagggcttggcaacatatttttatggcaacaattttaagtcataaacttggttattatggtttgccaagaaagaaacaaaaaatgggcaacctaaagcatgagcaaaaggaaatgttacaaaaggcaattgaatattatgagaagcattacaaggggcgtatcaaatttgccaagatatatgattacagcattaatgatgtaaagagaataatgagaagaatggcaaaacaaggcttcggttatatgctttacgatacatttaaagctgaagatgcggcttcaaccaatgtaacaggtgagctaattgaagcctcaaaacagttattgcaagttgcggaaaaagaggatatttgcatcatcattacaatgcagttggccatttatatggagaatacgagatatctaacagcgtcttgtttatcaaatgccaaagcagttaaggagattgtttcagagttagttctaacaagacctttatgggaggatgaattcccaggaggaaaattcgatgttaaaccctatagattcaaaaaagactcgtcgggaaaatttacaaacattaaagaagaaattcagttagacccaaataagaagtatagattattctttttgaataagacacggaatgacgaaggcgatacagtgttgttataccaatttgacggtgcatggaataaatggaatgagctcggttattgtactcctaaacatcagagaactacagagcggacatgattaccaagggacggtgaaatcatggacgtatatgatcttaagaatcacattattgaaaagccagagtacatagtacttattttagaacagacggggttttacaatgttgatgaacgcgggaatgagtacagatgtgcgagaaaaaaaggaagaaatccgacttcagtaaaagtaaataaaaccactttaggtgcaacctgtttttcaaccaacttaaaaggtgacttgataacacttgttcaaaataaattgggtttatcttttcccaaaacaatcaaaaggatatctgaaatagttgattataaaagtgaagaagaatataaaccacctgagttaccattcggaggtttttataagaatataagaagactaagtaatccaatggatttggatctagaaacgtattccgatgacattttagatcaatttgtatctgttccaaataagttgttttatgaggatggaatattacctttaactcaatctttgttccaggttggttacgatagtgtttccggaagaataacggtgccatggaaatctcttagtggtgaattgtgtggtgtaatggggcgtcttaataagaaggaagttaatgatgaggaaacaaaatggctgcctattatttcatttcccaagtccaaaacgctatacgggtttgttgaaaattacagttcaattagagaaaagagcattgttatgatcggggaatccgaaaaacattcaatggccttagcaagtaagggattgaatgttggagtttctttaggaggcagctttttaagtgaaattcaagcaaatcacataaaatcaatgtttccgaaaaagtcattagtcatgatggatgaaggattaggtgaagaacatagcgtagaaattgccaacagcctaaagtttgaaaatttctttgaaaatgaagttgggtacatatttgatcgtgaaaacaagtatctgcctaagggatcaaaaatggcaccagcagaccttgataaaagcactctacaccgtctaatcagagactgtacagtttggatatgaaaaggagatgattgattgaaagaaacattaaatgaattgagacaacaagggaaaaacatttattccttttcaaagcttggaacctttaataactgtgaatatgaatactacaatacatacgttttgaaaaagaaaggcatagataatatttacacccttatgggttctgaattacataacggaattgaacagatttataaaaatgaattagacattggtgaatttaaaaagggatttgaaaatagattaattgaattagagctgaatggagtcaactttccgagtgactcaatcggagacagctggaaagcagacattggtcatttcctaaacaattttaataaaattgacagcaaaatggttttagagaagctgcttgtatttgaaatatcagatgggatttatcttcaaggatatgtagatgcaatccttcccagtgaaaaaggaaaaccatacgttagtatttatgactggaagacatcaagtaagtttgccggcaagaaattaaatgaagcaggaagacagctattgatgtacaagcttgcattggagcaaacaactgacttaaaagtagataaaatactatggttcatggtgaaatacgtttatgtatgtacccaaggaaaaaccaaagtgaaaaagaaaatgtgtaacagaggtaagtgggtaaaggaaatacgaatgaaactagaaaaagagatgcgcactttggagtatgatgatttcgaaattgacctattgttagataacgcagtaaaagaaaatagcattgactgcttacctgccgagattagaaataagtattggcttgaagattgtttagttgaatacgaagttactgaagagaaaattaatgaactgaaagattatattactggtactgttaaaaagattgaaaataaagaccgtgaagatgaaacccaatgggaaccagtgaaaatagataaatacaattccttttattgcagtgtcttatgtggtcaccgaaaaacatgcaagttttataaggattttttaaataaatcatcaaataaatttaagaaaaaggataagaccgatttgtttgataacctattttcttagggggtaatgatgaggaagatattctatgactttgaagtttttaaacataactggatggttgtgctgatcgattatgatactaaaaagggtaaggttattgtagatgatgttgatgaactgaaacgattctataagatgtttaaagatgatatttggattggttacaactctagaatgtacgaccaatacattttaaagggaatcctgttaggaatgaatccttattatattagttcaagaattattaatgataatgtaaagggatttaatgttgttagagaaggttataagatcccactgaataactttgacataacaactggtttccacagcttaaagcagctagaaggctttatgggttcaaggattaaggagtcatcagtaccatttgatatcgcaagagcattaacagaaaaagaaattaaggaagttgttgagtactgtattcacgatgtgaaacaaacaattgaagtgtttgataataaaaaagaggaattcgaaagtcaattggctttaattgaagcctttgatttagaaatgtctatgtttacaaagacaaaagcccaattatctgcatttatcttgggggctgaaaagcaaggaaacaggggagatgagtttgaacttagatttcctaatacattaaaaattgaaaaatacaaacacattgttgattggtatagaaatcctgaaaatctagattataaaaaaaacttaaaggttgatgttgcaggtgtacctcatatttttgcctggggaggtttacatggggcattaccaaagtataaagatgaagggataattttatgttgtgatgttgcatctctatatccttcaatcatgattgaatatgattacatcagtcgtaacgtgaaaaaccctttgaaatatactgaaatcagagatacacggttagaattaaaacgcaaaaaagatcctaagcaggctccctacaagatcgtcctaaactcaacgtatggagcaatgaaagatcagtataatccactttatgacccgttaatggccaataacgtatgtttagccgggcagctgttgttattagatttgatcgagaaaattgaaccgtattgtaaactgattcagtcaaatactgatgggttgtttatgaaagttgagaaagaatctgatattgatttaattaaggaagtggcgaaggagtgggaaaccagaacacgattagatttagagtgggatgtttatgagaagatttatcagaaggatgtaaacaactatataatcattgataaagaccagaagtataaatctaaaggtgcttatgttaaaaaactaaacaacctggattatgacttaccaattgttaataaagctatgattgagtattttacaaaagatattccagttgaaaaaaccatcaatgaatgtgatcagttaagagaatttcaaaagatatcaaaggtttcaaacaaatatatgtacgctctctatggagaagaaaggctacctgaaaaagttttaagagtttttgcttctaatgatgaagatgctaaaggtgttttcaaggttaaaacagaagaacgaattgaaaaaatcggaaatactccaccgcgctgctttataaataatgataacgttattgatttaaaagttcctgattatcttgataaggaatattacatagagatagccaaaaaacgaataaatgattatttaggaatatcgaatagaaagaaaacaaagaaggagaagtgatatgcatcgccattaagagtaaaaataaaattaaaacacacattttcaagtctgtttatggtatgatgattttgattcccttaaccactttttcttacataagttatgagcaacatttacataaaacagagggaaatgaagactcaataaaagaatcattttataagaagcctagacagattaggataccatcaagtgagaatattgtcttacggctatttaaaaaagctcaaactaacaaagaacagcaattaaaaaggcatacagagaagattatctcagcaaaactcattaaacctaagcaaagtaaaaaaaggcacaggaagggaggtgagacggtaaagcataaactttttaagagtaaaaataaaattagtattaaagaaaaagaaaacaagccaccggccgcaaagaaaaccatccaggttaagctgagtgcttatattgcccactgccaagaaggatgcacaggaacaactagaacaggtgttgatgtcactcaatcaatctattacaaagggtatcgtgttattgcaaccgaccctagtgttattcccttgaattcaatagttgaagtaagcattggtgggaaaaagttcaaagcaattgcaattgatactggaggagcaattgttggaaataaagtggacttgcttgtagcaaccgagcgtgacgcaattaattttggcaagcaaaaggggacaatctcaattattagttaggaggcgattaattgccgaagttttggtcttatccagaagggttaaaagtcatcataaatgagaatgcaaagaacgcttgtcctcatcatgttggacgggaagggaaaattattgagctgctacactctgccacatatgattacgcagtcagtgatgaaacaggtgatattacattcttcaaggagcatgaattaaatccagctaaaggaggttgattgtatgtttaaaaagggagagaaggtgattgctggtttcacaggagagattggtgttgttgcacaagttgataaaggacatgagcaattagaagttgagtatccagacggctcatatagagtgattggcttcagcaatgtaagaagggtggaagataaatgacgatgattattttagaaggcactgactgctgctacaaatcaacagtagcagataagctaagcaaagaactcggatatccggtaataaaaggatccagctttgaattagctaagagcggtaatgagaagctgtttgaacactttagcaagctggctgatgaggacaatgtaattattgaccgatacatatattcaaatttagtttatgcgaagaagttcaaggattactcaatcttaacggaagagcaacaaagggtcatcgaggagaagattagggataaagccaaggtgatctacttacatgctgatccgaaagttattaagcagcgtttacttgaacgtggtgacgaatacataaatgatcgtgatattgagccggtattaggattatacagagaagtaatgagcgatgttgggttacatacatattcatgggatacagaacagtggtctagcgaagaaattgctaaaggcataatctttttaacggatggggtgatttatgaagaaagtaattgcaattgacatggatcaagttttagccgatttactaagtgattgggtagcctacattaacacctatgatgatccttttctaaaagaggaagatatactgtgctgggatattagcaaatattcaaatacccaaaacaatgtttacaggcatttggattacgaattattcagaaatctggatgttatagaaggaagtcagagagcagttaaggagctggcgaagaaatatgaagtatatgttgttactacagcaacaaaccatccagaatcccttaaagcaaagttagaatggctcacagagcattttccatatattccacatagtaatgttgtgctttgtggcaataaaaacataattaaagcagacatcatgattgatgacggagtgcataacttagaaacatttgatggaatgaagatactatttgatgcaccgcataacaggaatgacaatagatttattcgtgttatgaattgggaggagattgaacggaaattactttaaaatatcattatatttagagtgaaaataaagttaaaaggagtgaattaacactccttagtaaactaacgtgcttctactgtaattttataaatcacataattgtcgttaatgtcatacgcgtaaaccaatgctgtgcccaaagttgaatgagaggatacgacaccactggaactaatgcttataaggttgcttccagatacaatttcccatcgggtgtagccttttaatagagatacgttagaattcctcagcatgtgaaaatcaactgtaccaagcggatcacctagctgcttaacttgatcaattgatttgacaggggttaaagcagaagcctgtgatgtgaatgcagggagtgctagtgctgtaagcaatagagcagaaacaatcaatcctttgtaaaactttttcataagaattacctcctaggttttgattgtgattacatctccagtctagcatgttaaatatttgaaatgtgtgaagtgtttgtgaaactgtttaaaatatctcttttaaagagaaaggggagactgtaatgggttatagacattatatgtataaaatcagcaaggaacttgtaaacgaaataaaatcaatgaattacaatgaattgtccaaaaagttcggtgcaataggagaagaaggttatttctatataggtaacctgcctaaagaggaaatttgggagtttgggaagttgtattgggatgatacagccgaccgcatttattcaaagggacaccctctctttgaaagagaagaagttatgaatgaattatcggattatgttccatatattgttggtaaagaagggcttgaagaagctattgaaatttataaaaacaaagtcattgcaatgtacgagaacttgcttattgatgataaaaatggaactgcttcagtaaaacaagagcagcatattaagaacaacttatctgagtggactagaggatgggcgttaaatacggatattaatgattcatggctaacatcttcttggaaatatgaatacagtatttttgagctggtcagattattaaaaaccatagattttgagaaagagacaatattattttacggttggtgatctaaataaaagatcaattttatcgaaatgagggtgtgaaatggaagttagatggttagttatttttaatgattgtaaaaccggcagttctttgagtgagcttacatatagtaaggatggggaaggaaaccacctaagattagagtcaatggtgcctcgtacaggtgactatattgtaggaggagatctgtcatcagatataaatgataagaggtgctttattgtgaaaaatgtcttctggaatctagataggagagatatagaggtttatctagatgaggttgacaggactgtttttcctttatataaatcgctataaaatttgtcttttaaagagtaaaaataaaatataagaggtggagtctgtagtgaactacccagaaagcttaaaagaggaagccgaaaaaattaaagatgaagtaagaagcggcaaattagacgaggggaaaataaaagccattgctaagtctgcagttgagtttttaagatctcaagaaaagagtcatgctcattgtgcagaagttgctggagcgattgctgcaaacctagatgagttcttcaagtcttatctaaaagaagattaatacaacaagataacaagaaaggataaagggatgtttattgaaaaggtactatgttagatgtaaagatcacaaaggcgaaaacgcgtctttggtaattgaagcaatgtctacagaagaggctaaacggaaggcattagacatacataaggtaaagactgtttataacgtgagcattggggaaggtagggggacaaattgccttcagagaaaacattcgccgtacataaagaatgacaacgggaaagctataatcatattctcgtagaggaggtatcggataattagggatactgccagggatatcattaataatgacgttgatgagattgaggaaatattagataagctttgggtttatttagagaacaatttaaggccagaggataaccgtatatggaagaggtgtgattcggatattttggcagcaacagtaaagctaagaaatttaaaagaaactttttaagaataaaaataaaatagttgttgattgtttgagagaatgcgagtatattagaaatataagaatcgaggtgatgcattggagtgtgttaaatgcaaggatcacattggcgaaatcgtttattacataagaatagctgacaacaaagaatataaggaattcgcggtacataaagaatgcggagaagcaatcaagaaagaatgcattgaaaattgtaaagacatgaaattagaaaagacattggattacttgcagttactttaagagtaaaaataaaatattccttttatcgagaatggagagatgctaaatggataaattgaaagtttgtttacataaaaaaggtgctcatacgttagaaagaactgttaatggaggctggatattagattcaaaaccaattactcaggatcaagcaattaatgaactagttgaagcggttagtgatttaggatattggtgccaagtagcaaaggatgttttagataatgaagactttaatgcagttcaagaggcgtatgaataccatgagtaataatctagtccattataagaagggagaatgaaatgtcatatttggtgctgggactaatcttgttcggttcaatattcataggtaatggacttacaagtttagttgagaataaaaactttaaagaagccttgccattttatctcactgttttcttaatgggagcttgctcgctccttatcggatttattcttacagtgatatgaacaagatgaagggaaatagtgaaaggaaatataaatgatttcctgggaaagcgcagtatgcgacaaattggaacaaatgatgtctttaggtgataaacaaaaaaggagcatagagccatggaaacattagatgcaccaatttatgagattaagcaagaaagcaattggtataaaactgagaagaaacgaagagaagatattaacaaattctttgatgaattcgaagcaacatacggaattaagaatggtttttcgttctatcattccgagtatttcggagtacgcgcaggaacagaagcatatgacttctttaaagatgaagtggtgaaaaaccccacaaaagctggcttctatgcatttaaaaaacgttctaagtatttcacagacataaggtctatgctagagaaaatagaagaggcaaatcctttcaaaggccatgatgtgttcgggagaaataatataactgcaagccagtgggtaggtgatagatggttttttggcgtaagagatgagaaacgtgtagaaggtgaagaagctgtagctattgacttcaaagattatcttaaaattatcttggagaaattaggttaaaattcaatttttataaagaaaggagaaaaacatgagagacattacatccgaattcacattgagaggagtaaacagaaaaactctgaaactcctggcaactaagagtattgattatccagatacatgggtaaaggttcaaattggagatcaaatagcagaagttgaggcaaagcaactgttggtggcaataacggcatttaatgaaatgtgagaaggaagaaactaacatggagaagtgtagagcagtatttaaaggcaagaaaatagaaaagatttaccttttcagggcatatccatcgtgttttcatggcgtccatgcgaaacgaaagccaccagctattgaccacgagtatttagatatatctactgaaactttttatgaggatgaaattaattttgaagttaactgtggtgacactctttacataaatgaacttgatgaaaatgttcatatagaaaaaaaggtcaaaatgcttgatgggggatggatttacttcactgattatgtcattagcacagtcgagaataaggagagtaaaattcaagctgaaaaacaattaagggagtatttagacgaaagtaaagtaaaagaaaagcatgataatcagctaggaaataaaaggatatcattttggcaacatttgaaacatgcttttaagaaagagatgcaacagtaggaggtgaataagtgggacgacataaagcaacatttgaagggaaggtaattaagaaaagttggacattaggcttgtgtgatgcccttgtcccaatcgagcagcaatgtgagtatcagacattttttgaagggaacatcgacttagacccaattgaagtcggagggaaagtgtatatcccagggtttaacgaatacgtagtcgtaacagacaggcaacgcaacacaaaaaatgaatggacatatcagactgacaaggtcattaaaacaattgaggataaagagagccttgaaaaagcaattcaaaaacaagaaaaaatagagaaatggaatcagcaagttaaacaagactatgaacgctttaaagagcaagaaaagaaacgtaaaacttcctggtggaagaggctaatcactaaaaaagactaaaggagagatatttattgaataaggatacaaaagatatttggaacggtttctttatcggatcaggttctctgattgtagtggggttactcatttttgttgaagcagtgactatgtcactagttgtctattatggattgaatcatgtgttaaacccattgcttattgatacatacaacattcaaaatacccatatcactttacctcatgcatttgtgattggtgttttactcaacgtatttgtcaaaggtgtaaaacggtcagatcaggaaaaagatgagaacattttcaagaaagccggtaagtctttacttcattcagcttttgcattgattgttctgtatgtcagtacattgtttatttaacgaaggaggaatctgaatatgattaaatcgcagcaagttaaagtttttagagagacgttacattgtgatgaatgcgaagaagctccagagcttgtgttttcaaatatgatgctcacatcaaacccaccgaaatatccgtttcaatgcccattgtgcatgaaaaaagtttatatgaaaacaacctatccaaaggttagataccaatcagttgattgaagtctaaatgaaagttttattttattgaaaggatgaagaagaatgaaaatgagaaatgtaaaactgtacaaaacgactgaaaacgtttttcttccaaatgaaaaaacattggtagggacttttgatgattgtgaaatgtatgaaggagaaaggagtgtattcttagagattgcaaataaagatgatcttaaaccaagtgactctagtattcatatagaagatcctacgattttagaaatcacaacttgtcaaggcaaaacaaagactattaggacaaggaaaaggttaactgacatttcttctgatttaattaaaattgaattcacagttctgtaggtcgtaataaaaggatgattttagagagaaaaggaggaatagctatggcttatgatgagatcaatgggaaattaattaatcctaaagttagcgatgtaattaaagcgctacaagaccaacttgattttaacggagatacaccaattcaattcagaattgatggtgaagaaacaagcaatgaaattcaattagatccatataaaaatgttcttgtgtttcatttagatgaagtttaaggaggaaagctacaatagacacatttgttttatcggttgtcaggatagacattataaaggcggtttatatatggttattggagaagcagttcacactgaaacagaagaaaagttggttacatatgaaggccaagacggtgttctttggaaaagtgattattgatgggaaagagatcaagagattcacaaaagtaaaataaaaggagaattggctatggggattaaagcagcagtttttgaaataaaagcaacttgttacgctcatgagggatttaataacgaaagtgaatctgttcaaggggctgcgttagaacagctaggaaaggatatcgtagataatttactcgaaaacggtgttgatgatgtaaaaatcaaaggcgattacgttgaggaattgggagttgagaagcccgttatgaagtacttcgaagtgagcgatccctattatgcgttaattaaagcttactcaaaagaaaaggcaatgaagttatatacaaaagaagttgctgatgatgacggggaattaagtgatgagatgactgaagttggacaagtttatgcggcaatacgacaaggaagggttccgggagaaggtgaagagcttatgccatttaagcaggttcttgaagagatttctaatgatgaagaaatggtattactaatcgagggcagtttactttaacggataaaaatacaaggaggtgaattcatctgggaataagtcaaagacagggcaaatatatcatggaatcgattaatgaaacaaattcaattgcagaaataattggtcatgataaagctatcagtgaagtgttgcttctattaagggaaagagtgttgtttcttcaaagtcgatatgattttgaagaagtggaaataagattaaatgagctcatgaagctgtatgaaagtatcaataaacttcaaagaccacgaaaggatgatgaaaatgaataaaaaatacggactttattgcatgggaacacttgttaacacttatgatgacgctattgaggctcataatgatgctgtgtatgctcaagaagaaagtggagtgccgcatgaagtaagagaaatcagaaaaggagagtagataggatggaatacactaagtatggaaatcttgtagaaggctatataacattcaatctttattttgagacatttgaatacaaagaagatagcttattagaacaagtaaaattcaccacagttaaagagttattcaacatgatgcagccagactatgttgaagaactaaagcaagaaaacggtgcagatcaggttgacgttcatgatatcacgtttagcgctaaagaagatgacactgaggctttcatcacaatgtatgacaactcaggaaactatcgaatctcaacaaatcttgatgtaagtggcttggatagcgagtacaagcaaacattaaaaagcattaaaggtattatagataagaaactttgagagtaaagtaaaggatgatgaaaatgaatattagagagtttattgctgagcagagaaaagacgaaaagttcttgggtttgagatcaaaattaagggaactaattgaacacagaagacttgaacttgttgaaatgcttggatataaaatcgatagtttgaatcaagagcaacttatagaattcaaagaaaaattcagtgaattaactgcatttaaagaaaaggtaggtaatgatcctttcagcattagtctggatgaacttggcgaacttctatgtttccaaaaaaaataaggaaggtagatacaaaactctggagtatgttttgagtaaaacgattgatccatacattgataaaccaaaacaggctacagttatttctagataaaatcacagtttcaaaggaaggggaagcaaaatgagtgcagcaagaaagtggagagatttgagaagcaaattaattggatataaggtctacggtaagttcagcgatgttgttattgaccatattctaaatgatatggataagttagacgtaagacatgacaaagataaaaacaaaaaataaagaaaagggagttgtggaatgggagctgctaaacagttatacgttaagcgcagtcactttgtaaccttggatgaagcaaaagaaaatacgcaagtacatatgaagaatggtggttcatacactgctttaaaaggagagctgattgcgactaatcttgaaggggatcaaatggttatcacacaagagcagaaggataactacattccagtaccaatgacagagttatcagattatgaagctcaaatggccaaaggctatgctgaaatgggagacattaatttagaaatgtctgaagcttttcatcatgctgaaaatgaagcagaaacaaccaccaacagtttggttaacggagaatataaagaatattgattattacatatgaaagcaagacaggcaatgtgaaaaggtttgctcaagctttacaaagggagttaaacttcgatgtcattgaaattacagatgacttaatcattgaagaagaatttatacatattacatatacgataggctttggggaagtacctgaaaggactttaaactttattattaagaataaaaataaaataaaaggagttgttgtgagtggtaacaaggtttggggtgataactatggtttagctggggacaagctctcagcaatgttccacgtaccattgttattaaagtttgaactaagcggaacaaaacaagatttgcagaagattaatcgggaggtacaacttattgacaaacacaataccaaagtggattaagctcaataatgagatcatgattcagaaagacggtaagtttcaatttgagaaggataaggaggcagtacacagctactttgttgattacattaatcagaacacagtctttttccatgacttaaaagagaaactggattatctgactaaaaatgattattacgaagaagaattcttaagcgaatacacatttgagcagattaaatcgatttttaagattgcttacagttacaaattcagattcccttctttcatgagtgcctttaagttctacaatgactatgcattgaagacaaacgacaaaacaaagatattggagagatatgaggatcgtgtctcaattgtagctttatattgtgcagatggtgattatgaaaaggctattgaggaagtacacgccatgatgaaacaagagtatcagccggcaacgcctactttccttaatgcaggacgtaagcgaagaggtgaaatggtaagttgcttcctacttgaagtgggagacagtttgaatgacatctctcgtgcaattgacatttcaatgcagctgtctaaattaggcggtggtgtagcattaaacctaagcaaattacgagccaagggtgaagcgattaaagacgtagagaatgcaactaaaggtgtcgtaggtgttatgaagctattggataatgcttttagatatgcagatcagatgggacaaagacaagggtctggagcagcttatctaagcgtattccacccagacatcacagacgtccttgataccaaaaaaatctcagcagatgaagatgtccgagttaaaacactgtctattggtgtagttctccctgataaatttattgaattggcaagagaagataaggatttttacatgttctatcctcactcagtctacaaagaatatgggaagtatcttgatgagatggaaatcaataaaatgtatgatgagcttgttgaaaaccctaaagttagaaaagcaaagggaaatgctcgaaaactgttagagcaattggccattctaagaagcgaatcaggatatccgtatatcatgtttgctgacaatgtaaataaagtgcatccaaatgaacatatttcaaaagtgaagttttctaatttgtgcgttactggagaaacacttcttttaactgagaatggatatgaaaaagcagctgatctttacaaaaagcagaatgagcttaaagtggtcattgataatagaacaaaagattttgcagttggcagcaaaggtacttcaatagtagatgcaattccaatgcaattgactaaaaaagatgcggaaatatttaaagtcaaaacgaagcaaggatatgaaataaggacaactgagtggcacaaattctatgtgaaaagggacggtgaaattcaaaagctccaattgaatcagctaaaaacgggcgataaattattagttcaatcaggtgagggagcatacggcgacattcatgagccagatcttgcttacatcatgggcattatagctggggatggaaccattactgaaaaaactgccaagatttatttatacgataacaaaaaagttcttgagcagaaagttactgatgcagttcaccgtattattcaaaaacacaagctcgatcgtgcttataaacacaatacatcactggctccaacatttaatatggctaatccagaaaaacaagatttactctacatgaatagtacagtcttatttgacatcttgaagaagttcggtatggacaaagaaactaaaacaagagtcccagaattcatttttcaagctaataaggaaacgcaagcagcttatttatcaggtttattccagactgatgggtgtgtaaatgcaaatcataaagccaaagcattaacaattgagttaacatccattcactatgagagccttcaggacgttcagaagctattactaaacatgggtgtttatacaacgatctattctaacaataagcgttcacaagaactccttcctgacgggaaaggtggttctaagctgtacaatgtaaagccaactcacaaaatcagtattcaagatagaaactcaagagagttgtttatgagcattgttgaaatgaaagaatacgatatttataaattcaatttgctaactgagacattgcaaccttcttcaagaaagccaaagcatgattttacggctgaaattattagtattgaagaagatggtgttgaggatgtttatgatacaacacaagaagactatcactctctgattttcaatgggattgttactggcaactgttcagaggtgctccaagcatcacaagtctcagtttatacagattacgatcaggaagacgaaattggtttagatatctcatgtaatcttggatccatgaacattgtaaacgtaatgagcaatcaatcaattgcttccacggttagaatagcaattgactcactaacgactgttacaaggaaaacaaacattgtaaatgccccagctgttgcgagagcaaatacactaatgcgatcaattggtcttgggcagatgaatctacatggttttttagctcaaaataaaattgcttatgaaagtgaagaagctaaggactttgcaaatacatactttatgatggttaacttctactccctgcaacgttcaatggaaattgcaaaagaaacaggggagacgtactacaagtttcacggatcaacttacaaatcaggcgagtattttgataagtacgtgacaattgattatagccctaaatatgaaaaggttaaaagcctgtttggagatcaacatattcctaacattgaagattggatgaagcttaaagaggatgttatgaaatatgggttgtatcattcgtataggcaagctgttgcacctactggaagcatctcatatgttcaatcatctacagccggtgtaatgccgattatggagagaatcgaggaacgtacatacggaaacagtaagacatattatccaatgccaggtttatcggctcagaattggttcttttataaggaagcatacgacatggatatgtttaaggtagttgatcttattgccactattcagcagcacgtcgatcaagggatttcatttacgctgttcttgaaagatacgatgacaacgcgcgatctgaaccggattgatttatacgcgcatcatcgtggcattaaaacgttgtattatgcgcggacgaaagataccggccaggattcgtgcttgagttgcgtagtttaaacgaaggggaggcggagtcgtgaagttagaaatcggtcaagagtgggtcagtgaaaagcacccacatgaaaactttaggatctacggaggagtagtggatacttgtgcagactcatttaaggacgaaagcataacattcgatgagcagccggaatgggctaaaattttcttctgggagcgggcggattatgcgagtttcgataaatacgtcgaatcaaagctaggaaggaatcgagatagtacgtatcctttcgctagatgtggagagacgaagaagtccggattagtagcaaaaatcaaaaaattcaatatggtcgttaaagagaaggaggatgaataattgacgcaatatacagcagcaaactggtcaaagcatgaagatgatttcacccaaatgttttacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacgggcatgccgattgtggccgagcacgtcgagggccatcagcgaaaagcggttcttaatttcatggcgatgatggaaaacgcggtgcacgcaaaatcttacagcaacatctttcttacattagctccaacagagcagatcaacgaagtgtttgaatgggttaaaaacaataaatttcttcaaaagaaagcaagaacaattgtttcaatttatgaagcagttcagaaaaacgatgatatttccttattcaaagcaatggtagcgtccgtgtttttggagagtttcttgttttactcagggttttattatccactttacttttatggacaagggaagctcatgcagagcggggaaattgtaaatttaattatccgtgacgaggcgatacacggcgtttatgtcggattgttagctcaagagatatataagaaacaaactcttcagatgcaaaaagaattgtttgaatgggctttaagcttgttgcaggagctttatgaaaatgaattggagtatacagaagatgtttatgatcaggttggtttagctccagatgtaaagaaattcatcagatacaacgcaaataaagcattaaacaatctgggctttgatcattggtttgaagaagaggatgttaatccaatcgttattaatggattgagcacaaagactaaatcacatgacttcttttcaatgaaaggcgttggctataaaaaagcaacggttgaaccattaaaggattctgatttcattttcgatagcaaaggagttatttcatgagactgattaaattagaacaaccgaattgcaatccttgcaaaatggtatccaattatttaaacgaagcaggagtcgaatatgagacatttgatgtaacacagaagccagaagtggcagcgcaatttgaggtaatgagtgtaccggtgactatactgctgaatgagcaagaagaagtaaagcgtagtgttggatttaagcctgaagaacttgatgaactactaaagggattacaataaaagataatttccttaggggagggctaaccatattcggttggaatattaacgagatttcatggtggaagtacatactgcttttaatttttttaattactgtaatacctttgttgataatggattggataaccttctgtaagattaagcatattgactggattattcaacgatattcatgttgggcggcctatttaatttttggatagatttttcacataataaaacaaaaggagaatgttaaatggggaaaatggatgaagtaattgttgtagcacctagagataaagtatttgataatgaagaactagtctttcaaggaattgaatctgatctaggcaaggttgatcaaataatcgaaaatctcgctgaaagcatgatcactatgaataggggagatgctgagagggatcaaagctgtaagcaaccaattccctatgccattttacaaaaaggagaccgagtatttgcatacgagcggttaagaaaaagcggggaaaagaggcttcatgatcaattatcaattggtgttggcgggcacatgaatttaactgaagcaacaaatttttgggaagctattgatgagaacttaaggagagagctttcagaagaggtgtttatctcaacttccaatttaaatttagaagttgtggggttgataaacgatgacttaaatgaagtggggaaagttcatttaggcataatgattattgttaaactgcctgaaaatgcagaggtatctgtaagagaaacagatcaattaaaaggcttttggttaaataaacaagattttgataatccattagtatttaatcgtttagaatcttggtctaaatacgtggcagatattatttattagtttaaacccctggctttgatcatgatgtttgtcagtggagggtctcagccagggtacaacttaaaatactcaaaaaactcaacaattatgcctacaaaggagatgctggatgaaaaaaagattacgcaaaaaggcgtggatgacagggaatataaaacagggcgaattcatgtttaatgtaattgataaggtaaatgcagatggacatgtatattatccaaaaggacactatcatgtagacaggaaagggaatatgtacaagttcaaaatttagaaacaagcgaaattgtgatgactaaagttgataaagatcttagggataccaaagggtgtcgattgaacgaacatctctataaaagaagacttttatttaaaataaagaggaggaaacagaccataaacaataacagtcataaagatttgcaagcaaagtatgatgatatgctcttcagaaacggactttgtttggggtttattcaaaaacaagggcttgcagatgtgtttttggagcatatgaaacaagttgcagcttatgaagaagaccaaaggtatagagttgcagcagttaattttttgagtttattagaatcaaattaaaacaaaaaggagatttgaaaatgaaaatttcaattaaaacaaggctaaatcctactgatcaatataaggttgacgactttattaatgcatttaagaacttgccgccagaaataagaattcagctttctatggacaacgggaacagttggctgttagaacaagtgtcagtgaaaacagaaagaatccttcttgattgtttacaagaagaaattaaaaatattgataatcaccctctttattctcatgccacttcattagggcaaactgtattccacaatactcatgaaattgtcgatgttgtcaaagagtatgtgaagaaaaatggataaacatatagagaaaatacaagcccatctaaaagaaatagaaaattttaaacaaggcctccaattattcagtgaagatgaagaagaatacataagcttattagctaagattcaacatcagtttgatttaatttcagacgaatcaatggaagggtttaaagaattaactttacatataagaaatacaggtcagaaaagaatccaacggagaattgatcagttacctcacacaatcaaagaaagtgtaagtgaagaaattaaagacatgaagagagccggcgagctttttgattgatatttaaattttaaacatggctatataaacagtgacaagtatcgattgggtgtgaacttaaatacaatacattgaaaactgtgaagaactggaggttttaatgtgtttagacaatatccaatatggtacacaccgtcgctgcatactttgaattacttgccacaatttacaccatacattgcccactttaatagtgctgaacgatgttttcaacgatgtatgtaccaaacgcatggcaatgttgaatggtgccatagaaactgctacgacccgatctatcaataaatttaaccagagcagttggatttaattcctctgctctaaaaaataaaatagggggatgtattataattacatactttacgttaatacttgcagcatacttatttgcactaaacattaatgaaattagattaattactcgaggggaacagaacgtatacgctaaagtcacacatttgctttctaactcaccatataaagaactgaagaagaataagaacttagtgtatgtcatgacattgttcaaggggatttcgttcattatccccttggctactattggactgattacgcatggtaacttgctaatgttagcttgaacagcttttgctttaatatataccggtttaacaatgtttaaaattcttgatgttttggacggtgactcaaacaataaacaaaacaagttcgtgtacatgctttttgtttgcggtaatattgtcttcgtggttaactttattatcagttggtttagataaaggagaatagaattatgactcagtttgatatgcagtacaacacaatcataaatgacataattaataatggggcatctgacgaagaattcgatgtcagaaccaagtgggatacagatggaacaccagcacatacattaagtgtaatcagtaagcaaatgcgctttgataattccgaagtaccgattttaacgactaaaaaagttgcttggaaaacggcaatcagagaattactttggatatggcagcttaaatcaaatgatgttgacgaattaaacaagatgggcgtacatatctgggatcaatggaaacaagaagacggtacaatcggcaaagcatatggatatcagcttggtaagaagaacagaatgctaaacggtgaaaaggttgaccaggttgattatcttcttcatcagttgaaaaataatccatcatcacgcagacatattacaacgctttggaatcctgatgaattagactcaatggcattgactccctgtgtctatggtactcaatggcttgtaaaaggcgggaagttgcatttagaagttttctgtcgcagtaatgatctcgcactcgggaatccgtttaatgtgttccagtacaatgtattgcagcgtatgattgctcaagttactggctatgagctaggtgagtatatcttcaatatcggagactgtcatgtatatactcgtcatatagacaatttaaagattcaaatggacagagagcagtatgaagcacctgagttatggattaatccagatgtaaaagatttttatgatttcacaattgatgatttcaaattggttaattataagcatggagacaagctttactttgaggtagcagtataatgctatctcttattgcttgctgcgataaatcaatggccattgggtatgaaaataatttgctttaccatattcctgaagacatgaaacgttttaaagaactcactacaggaaagttgtgtattcaggggagacttacatacgcttcaatcgtaaacattacaagaaagccacttcagaaccgaaagaatatcatattgactaaaaataaggatttcaagcctgatcactcttcatttgtttatcattcgattgatgatgtattaaagcttataagaggacaattggataaagatgaagaagtaatggtaattggaggaggtgctatatacgaggcattcttaccacatgctgataaggtttatttgacgattgttgattcagttgctgagaaggcagattcatattttcccaggttaaatgatgactggagagtaattgaaaaggatcacaggaaagcagacaacaataccacatttaattattcatttgtgacttactcaaaataattttagaataaaaataaaatagttatagactttttagaagttgaatgataagataaagacaagttaaaagcttgtcttttttttacatacttttagaataaaaataaaataataaataggagtggcgatatgaaaactgcaacagattatcttgtttccatttccaaacctcttgttgcaattgaggagactaaacaacgacttcaaaatgaaattgataacctttataaagagctagggaaagttgataaagagctcaatgaattttatcacaagctagaagaggacaaatttaatgcttcagagggatatcacctttcgttgaaaggtcaaaagatattgagaaagcgaagaagcttaaaacaagagctccaattactgaacacgcttttcggaagtttaaacaataatggatggactcttgaatcactgaagattgcagaatataaaattagcaaaaagaaaaacaagcatttacagtatgaatcggtttaaaaacaagcctacataattaaataaaaaagagagggaagccctctcaatgtattagtaattataatcccaataaacatcaacattaacttttacttgagctacactgtcattgttatgtgctcggacatacaattgttttcctgaaataagtgatgtgtttacgctaaatactttgtaaaattgttcactaatataatttccgccactcggtgtaacagaagccagcacagtgccatctgacttcattaattcataagtcacatttgcacttctacttcctgtccctgttgaccattgtttccccatgatggaaatcttggttacgttgtttggtgtaaagctagtgactactgttgcgtaagatgcagggcctgaagtagatctacctatgttgacttcaccaacaccatttttaacgtgagtatcagtcccaagagcatgaaaactaccggtgtttgttaagacctcaagattattttgaggggcggcaaccggctcacttttagcagtagcattcgctgacgcagctacaccagtaagaccaatagttgaaactaataaagcaattgctgttttcttcattaaaagcatctcccttggtttaggtatgtaatacaactatattataacaattaattttgaaataaatggagaatgttgtgaatatatggtgaattttctgaatggagtgtgaatttcttcggtgagaactttaaggaggtgatatattgcaacaaaaagagcaagaattgctgtcaaagaaagaacagcttgaaattgatgttttagaaaaggaagcagctttactccggctagaagtggaacaagaagattccaatctccacaaaattggggagatcggtgtacttaaagaatttcttttatacataaagaaatacagatcaatgtttactgtgcagcaagcagaagaatttagaaatatggatgaccgaatgaaagaaatcatcaaagtccaggttggacaagtaatggttgatgaagaagctttagagggatttattgaggaaattgagaatcaaattaattgaaagtgggagatgaggaatgaatgaaaaattaacgaaagatcaactcgaagaaatccgtcaacgtatggaagcgacaaccaaaggattttggcatgcaaacattcaccatgaatggccagggaacgaaaatcttcgttattggatagttactcttgaggatggtttagcagctgcagtaactaaagaagacgcggacttcatcgcaaacgctcggcaagacattcctaggcttctcgattatataactgagcttgaaaggaaacttcagaaaaaagaatatgaacttacagagtgtaatcgtgtctatttagagctgttgagtaaacaagagttcaaaacaactgaaatctaagtaaaatctgtattttaaagagaaggtgatgcagtgaaagagtcgttgaagaatgattttcaagagtttatgagtattgcaaaaagctttcttgctgtttctggagcagtcttttggttattgataatttcactcgtttttgctgggggctattaaaatgaatcaatcatataaagttagtctagaaaaattaccaattgaaagcttagagagactgaaaacagacatacaaaatagaattaatgatggattgcgtaccgataacaatgcatacataaaagaccaaagaagaaaacttcaaatcgttttaaacgagctggttagacgaagtacatttgttcactaaaggaggtgaatacaatgccagtagtactttatggatttggaagaggagcataaaaagagaggggagtaatcccctcatacattaatgaaattggccattcatgctttgttgggctaggcgaactaaacgttttgtgatttctccacctactgaaccgtttgctcggctagttgtctcaggccctaagttcacaccgaactcagaagcaatttcatacttcatttgttcaagggcaccagcagcttgaggcacaagtaattcattgctgttgtttgatctgttttgttgagccatatgatcatctcctaaagttgtatgtaaacaagcttgttcaattgtattgtgtggagatgttttgtaaatatacacattaatttaaagtgaggggatttaaatgtcaattggtcatggagcatgaattaacacgtacttaaacaaagaagggggataaaatgaaaatcgattatgtttcagatctgcatattaatcactggataccttgggacaatgaccaaattaaatgggaaaggcgaacaagggagattattagaaggctgatatcgaatggaaatggagaggtattaatcattgccggtgattttactgagtggaatcaacagacactgtgggtacttgatgaagtagcaaagcagtatgaaaaggtttacttcacatatggtaatcatgatctttatttactcagtaaaaatcagcaacgaaaatattccgattcattgggaagggtgaatgatttaattcagaaggctacagacatcaataatgtcactccattaataaagtctacggatacatacaaagggaaagtctttgcaggagatgttatgtggtatcttccaaaaggaaatgaaggatgggatttcttcaaaggtgtctctaatgattcaaactatatcagccttaatggatacagcaaagaagatggggtacgagcaatgtggaaagaatcaatgggctggtatgacactcttgaaaactctcacattgatgtatttgtctcacatgttccacctgttcacaatccttattctccgtttgagcctaacagctgctatatggttgatgtcccgttcattaacgcaaaacattgggtttgtggtcatgatcatttacaagctgagtttgacaatgatggaacgagctttcacatgaactgcattggatatccatatgactatgatatgtatcctagagtaaatgagataccaggtaagcaagttgatacgtataaaacgtttgagctgaagacatttgaaatcaaatgaaattctaattttatacagaagggagaaagtaaaatgtctaatgtgaaaattaaatatgttacagactgtcatgacaaagagtttacattaaataaaaaatatgattttcgtataaccgatgatggtattgaaatcattgatgatttaggtgaagaacatatcattgcaactaaagacaatgaatatggggcttatgaacacgatgaatttttcagatcaagatttgaatttgttgatactgaataaaatgttgatttcatttagaagggataagttcaatgaaagagattgaatttgatgaagttaagaaatttgttgaagtaatgtctagagaatttagatcaacaaagatgatgaaaattaaaattagctatgctgaatggttagttgatgaagttgaacgattaaggggttagtcaaaagtgagcaatagtttagagagaaagattaatattcatttcagtaatggctcacatatcgagtctaaacaactttctaataaactaagggggtacaatagcaatttcttatgggagcaaatgcaagagagtatcacaaaggaacttaaatggtggggagtcactctaactggaaatcagaaaactgtaaaagctttaagtgagctaatgaccattaacaaaacattgtttgagaacctttataaggtgcaatcagacaccatagaagagcttgcaaacaaattatatgaacaggttcctgagtatgagaagaagtttttgaagtttgtcaatgaacagatacctaatctgaggatgtgcctacagttcgagctaccttataatcctcaactaatatccagcatagaatatgaaatttacatatccggtgccgaaattgattgcgaatacccacatgatgctagggattgcattattactttctttcaacggataccagaaataatcggttcatacaaggaggaattagatgaagaatacagagtttaaggtaacaagtttattagaggagtataaacgaagagatgaggaacgtagggaattcatcattcatgaaggctacagagctatcgaagagatcattaaagaagtgaaccaaagaggatcactaaatgaagcagatatttattatggaacacctaaaccacagttaagcttctcggacgtcgaattaggctacatgcttacttctatgatggaatatgctacaaatcatgttggaaatccagttgatgaggaatgtgaacttgaaaataagctggcttactttgagcataaggacgaaattgttcaagtttttgaagtatatggacaaggtactgacagctggtttttgaaaccaagtgacgataccgtttataaattgaataacacagcttacggagtgtatttaaaccagttcgatgatttcattaattacactaaaaataaagacaatgagagtaaaaaggtttcttatggtaccacgatcttaaatgacattgccggcggatatacagttggaagaggttctaagtagatgatcgttacagcttggattttgtttgttgcatttgggcttgttttgttagcaagaatggattccgaagggaatcttaaatttgcagtgtatattggtgtaattaaatttgtttcagttttcattgttgccattgcagcaggagtgatttggggagggttatttcaatgataaagaggattatgagttttaagtttgacgactggagacatattttctacttattaaaaagtgtagcgaagaatttctttaaaggtgattttcatgaagcgagcgatgcactttattggatacgggtacacttgtcttttgaatcaaataaggtgaagtgaacattagataaaatcggtcatttatttagagtaaaaataaaattagatgattagaggtggagagtaataactgagtacattaagaacattcaaatactgttcaacaaaatggaaagacaaatgggtacggtgaaagaagctctcgagaacaaagaatacgaaagagcccaccgtaacctaatcaacctttcggataataatgaagaattgatgcaggaaatcagatgggctcggaaagggattaagatttaacttttcttctttcttcgtggttccattcgtacagctcttcaattgagcaaccaatggcatcagcaaaagtcatgccagtagctaagttcatatttgctttagctccacttatataatcgtggatacgttgtctggggtatcctgtacgtttgaaaaggtcatcaactgtgaggtcatattcaaacattaattcatttaaacgagggcgcaggggtgtccattgcttcatttcgaacacttctttcaatattaattaacataaaacagtgtagcaaaggtttattctaatttcaattttagtttcaatattttaggagagtgattgattgggaggtacaaaccaaggcaaggtttttgaagcaaatatagaaaaatcagctgcaggtcaaaagctgttcttctatagaattaaagatgttaatccagtgtttttaaaaaggggagctgcagtatcaaaaaacaaatatgattgcttcttgcactttaaggggtacttattcccattagagcttaaatcaacaaaggataagtctattgcctttcaagagaagattataaagccgcagcagataaaacacttaaaagaggctacgcaatatccaaacgtaatccctgggtttctatttcaatttagagagccggaaaataaagtttatttcgtacatattaatgatttccttacatataagaacatagctgaaaaacaattgaaacatacatataagaataaagtaaacaaagccagcattccaattgcaatttgtgaagagatcggcacagaagtccgttcgatgaagaaaaaagttaactatacatattacttgaataagctttgcgatgatttgattaaaaaagaacagcagagtgtgagcgctgtatgagtgaattcgttaaatcatcttcaaagcaatcgtttgaaatagaaaaatatcatataacgattgaaagcataaatcaaccatcagctgaagcaattaagaaagtcaacctaaaagtgaatgaagtaatgtctaatttattagcaaaagaaaagagccattaagccggctctttttttgttgtacttaaactataatacttgtgacgattatcgggatgaccttaatgccggtcgcgatgaatcatattgccggcggggaaggcagcaaggatttcggtgatccggctaaccttgccctcggatttacggtgcttgtcatcatcgtgctgctttatcggtttacaaaaggatttttgaaatccatttcaattttaatcggcattgtcatcgggacggccatcgcatattttatgggaaaagtgcaatttgacaatgtggcgaatgctgacgccattcaaatgattaaaccgttttatttcgggacgccgacatttcatgcggcaccgattattacgatgtcaatcgttgccattgtcagccttgttgaatcaaccggcgtctatttcgctctcggtgacctgacaaacaggcgcctgtctgaacgtgatttagcaaaaggctaccgcgcggaaggtctggcggtgttcatcagcggcattttcaatgcttttccgtatacggcctattcccaaaacgtcggcctcgtgcagctgacggggattaagaaaaacgcggtcatcggtgtcacgggcgcacttttaatgctattcggcctttttccgaaaatcgcagccttcacgaccatcatcccgtcttcagtactgggaggcgcgatggtggccatgttcggcatggtcatttcctacggcattaaaatgctcagtcaaattgactttaaaaagcaggaaaatcttctgatcgtcgcgtgttcggtcggattgggactcggtgtaactgtcgttcccgatatgtttaagcacctgccgtcttacttaaatctgctgaccacaaacggaatcgtcgccggaagctttaccgccgtccttttgaatattgtttataatatgattcctaaaacgaaaaaaacccttgatgtgacaagggttcaagagggttagttatccgtttttcttaaaaaaataacattttaataacatttctttatgaaatcccgagatcgaggatgcttccgaaagtttgctgaactttttgtgaggcatcctctttttttattagtttcattgtttgaaaagaaataaattgagtgatgcggcatccgccttatttcgccgaacaaccgtcccgaactatatgtacgtgaacatatgactgaatgtaagaaaaaaaggagaatgggggatcatatcataaacgaatatcattgttcggacggtgatgacacgaaacttggtttagacatggaatgaaatgcctgatgccgaagtgcaactgcagaatgggcgctgagggggagtgtcttgtgcacggatccttacaaaagagagtgaaaagaaggggaagccccttcttttaattaatccatccttcaaaagttgcgcgatagaacccttcgattatctctactttcttaaggtaataagtaacaccatttttaacagttgtatttgggatatcccatctatgaaggtaatccattgtaaaagaatctttgatcgcttgtgtcgaaatttttgtttcagttgagtcgctatttgtattgccagggctggatgcaaaagcaggggaagcggaaacgagtaaagcgagagacaaggcagaaccagttaaaacttttttcaatttcattttaaacactcctttgttttttaatacaattgtattattacacaaaatacaataataaccaagaggttttttgttaatattttgtgggcgcagcgtgaatttttttaggggagtggatggcaaaaggggcaatcctttcatccgctgttgcagcttatttcaggatactgatatgtatatagagaaaaagagttgattattgctggcctctggtgagctgcagcctttgagtgagtgtttgatttagctattccagcgcttttccaacgggaaaggtgtgatatgaaatttaaaactgaaacaattgtacaaaagtaaaaactttatttaaaatgttataaatactaattttcaatataggaggttatctggtggcagaaaagaaaaaagctttaatcattgtggatgtacaaaaagctttcgattataaaaaatggggagaacgaaataacgtaaaagcggaagaaaacattagtaaaatactgaaattatggagagaaaaaggatggacagtcatatacatacaacatatttctgataaacctggttctttattttatccaaaaaatgagggggttgctataaaggagatcgttaaacctatggataaagaggtcattataaccaagaaagtaaacagcagctttatcgggactaatctagaagagattttaaaatcaaatgatataacaactgtcgtaataactggtttgactacgccccattgtgtttcaacaactacaagaatgagcggtaatttagggtttgatacctacctcatttcagatgcaacagcagccttcggaatgaaagaccaaaatgatacatattatgatgccgagactattcacaatatatctctggctacattgcatgacgaatttgccacaatattaacgactgatcaattaatcaatgattttataaaaacaaactgattaacattatagctaaggccggcggtgggtatagcggctgaaaagcatattcaggcgcatacaaggatctcgtctgaaaaaaggcatctgcttcagatgtttttttgtttcttgaaaaacgggctggtaaaaaatgatcggcgcggttaacggtctgattcggctttggttttgaataacaaaaggttttactaatcagcgaattattcaagattttttggcttgtgctgagtctgtgtcttttgatttcctcgaatagattggcttgatcatctttttgtggctgaggctctttgttaagacattttgggtcgatcacatttttaaaatctttgatggttaaaggcttacagtcatcttttaattcgtagcctaattgtccattagcttctaaagtggcatatttaattgaaatgccaagaagccttaaacgcatttcgagttgatctgctgtcagtctcagcttctttaagttttgtatattagttggccgtcttctatatcgaatttagattttccggttaaaaaaaatcaatccagtttacttttacttgaaaccattccatcaaaattaaagcactaaaaggatagacgcagcgattaatgttttcaataaactggtttctaaaatgggatgaacgataatcgtaccgattgaaatcatcaccattgtctgtgcgatggtcatttgtgcaatggattttctccctgaaattctcagtaaaatcattccgaatgcaattataattaattcttcccaagcaaatctcatgttatcaccctagattgtgttttatcaaaaatgaaagagcaagtaagaggtttcttaacgttagctggggaactcaggcgtcgataaaatgttctggattgatagagttgagactcggcttttggatagacacgcgggagagaattttagtttatgtgtttttgcgtctaaaagcagaaacattacaactaataatgatcatcggatgtaataaaattacgcacctaggtgctatatgctggatcaattataaaatggagtgaaactaaaaaaaggggcaaagcccccttatattagcagctttttagttgttacttgagacaatcattccgccgtcatgaaaaatcagcttttgtagacggctgtccaagtgccatcagcaccatggaaggtgatgttgtctaaataataggtgattccattccggtaaattgaagtaggataatcagggccataaccattaagtatgaacgtcgccaaagcagatacttccttcgttttgctttctgcagaaggtgtatcagcaggacctgcggcaaaagcagggcggcagaacagagtaaagcgagtgacagggctgagccggctaaagcttttttcattttcattgcaaacactccttttcttttttaatacaattgtattattacatattatgttaaacatgtacatgcctatctttgttaattttttgtgaacaaacagataatctatttaaacgcagagatgtaataagtatgatgatgaagcaattatcatctataaaaataagatcagaaagcagatgattttctcgaaaatcatctgctcttgcgaaatgaggagttacatgacatttacggaacgggcggtagccattatcaaacagattcctgaaggaaaagtgatgacgtatggtcaaattgccggtcttgcgggaagtccgcggggagcgaggcaggttgtgaggattcttcactccatgagtaaaaagcatcgtcttccttggcacagggtcatcaatgcaaagggtgaaatcggattaagagatgaagagatattttctgtacagaagctgtctcttgaagctgagggcgtagcggtcacgtcagacggacggatcgatctcaatttatacgtccatgatccgaatatgtaaaaaacctgccgtatatatcggcaggtttttcagttatatgctgcaagccggccagaaaggttttgccggatataaggccattcctcccgaaggatggagtagtaggcggtatctctgaggccgccgtcgacagccggaatatgcgcgcggcggatcccttcaaattgggcaccgatccgcaaaatcgcagttcgtgagcgctggttgcgaacatcggttttcagcgtcaccctgacagcttgccacgcgtcaaacgcatgggtcagcaacagaagtttacattccgtattgacaccggtccgctgtacggcagaggcataccatgtgctgccgatctcacacacttccggggctgcgtccgccggccgcgtaaacacttccgcatccataaaccgcgtacttccgacgattcggtctgtttcaagattccgtactgcaaatggcaatgcaagtcctttttcataatcggaaagcgtacgttcaatataacgctttgtttcttcgattccgtcaggaacatgggtgtaagcgtaagtcgtcctattttctgaagcagcttcacaaagtgcctgagtgtgatcaatcgtcatcggctctaactgaacgagtgaccctttaagaatgacgggcttcagcattcttatcacaacctttttttatgaatggatcaagtatagtcgagcggcttatcattcaaaagggccaattttaaattaaaatggcatgtcagtgaaatcctcgcttcaaacttatgcatacattcaggaaaaaagcggaaacctttatgtgaagaggtgatgggcatggcatatgtgttatcggtcggaaccagcattccggaatatcatgtctcgcaagaaacggcggcggattttgcgagagggatgtttgccgattcatttaaggatattgaccggctgttaaaagcctttcaaaacggcgaaattgaatcaaggcagtttgtccggccgattgaatggtataaaacggcgcggggtttttcagaaaagaaccggctgtatacggaagaaaccgttaagcacagtgcggatgcggcacttgattgtttaacaaacccggattgtttaacaaatccctttccttatgaaaaagtggatgcgatcttttttatttccagcaccgggctttcgacacccagcattgaagcgaaagtgatgaatcagctgccgttttctgcgaaaacaaaacggataccgatctggggcttaggatgcgcgggcggagcggccggcctgtccagggcgtacgaatactgccgcgcatatcctgaagcatacgtgcttgtcatcgcggctgaactctgcagcttaacgtttcagccgaacgacaagtcaaaaagcaacttaatcggaacttccctgtttgcggacggaattgccgcagtactagtcggaggagaaaaggcgaaccgaaacgacgtcaaacagccgcttcttccgcggatattcgccactcaatcggtgatgatgccggatgcggaagatgtgatgggctgggaattcaccgacagcggttttcaagtcattttttcaagagatattcccaccctggtttcacagtggctgaaggacaatgttgatgaatttttaatagaatatggtgtcggtcctcacgacattaaaacctttcttgcccatccaggcgggaaaaaggtcattgacgcctatttaacgagtctttcaatggacaccggtcagcttgaggcatctcggaaggtgctgcaaaaacacgggaacatgtcttccgcaactatttttcatgtgataaaagaacagttgctccgcggccggcagaaagaaaacgaaaaagggctgatcggcgctctcgggccgggattttcgtctgagcttttgctgttcagctgggaaaagggggcttcttaatgttttggctgtttatcatgctgcttgcggcccagcggattgcggagatgatcgtggcccggcgcaatgagcagaaggtgaaaaagcaaggcgcagtcgaatacggagaaggacattatctctttctcgtcctgatgcacgtgctcttttttgtctctcttacagctgaggtggcggcgtttcaaaaaacgctttctccaaggtgggccgccattatatgtattattttatttgtacaggggatcaggtattgggctctattatcattagggcggtattggaatacgaaaattcttgtcgtgccggatgcggagcttgtcagaaaggggccgtacaggtggatgaagcacccgaactacgcggtcgtcatcttagaatttatttttctgccgctgttatacggagcgtattggacactgtttctcttttcgattctcaatgcctgcatgctcactgtaaggattcgcgccgaagagaaagcgctagaagaaaacaccgcaaaatagagattgaaaatcattctcactcatgataagatgtaaatatgaaaatgattctcattcaaggtggtgccgaaaatgacaatgttatttttatttgcagccgtttgtacatacagtgttttaattggtttcgtattgaaaaaagtttcgaataaatcgatgtcttcttaaacatctgcggtttttaatgccgcgggtgttttttctttatcagctgccgatatcggcggcttttttacgtttcctgaagaaaagtgggccattcttgtgtaaaatgggggagaggtttttttcagagctttctaaaaatgaaaacgtcatttgatgcgacagacacaaaggggttaagacacatgacagaagaagaacgccataacagggagattttcagcagaacgggtgccttatacgtacaattattggatcaccaggatgaaaaacgggccgatcagctcgcggccattatgaaaaaagcggctgatgaagaggtttatatcgcgtttaccgggcattattcggccggaaagtcctctttattaaacacattgctcggtgaagacatactgccgacaagcccgattcccacaagcgccaacctcgttgtcatccggcacggtgaagataaagtcgtgcttcatacgacggacggggcttatgcagaaattaaaggaagttacgataaaaaacaagtgcagcaattctgtaaagacggtgagcaaattgaaacggtggaagtctatgccggctttaaggagtcagagccttatgcggcctacattgacacaccgggaattgattcgacggacgaagcgcattttttatctgccgcttcggttctccaccaggctgacgctttattttacgtcgttcattataatcacgttcattcagaagaaaatatgctgtttctcagctccatcaaagaccgtattccgaatttgtttctgatcgtcaaccaaattgacaggcatgatgaaaccgaaacgaagtttgaagagtaccgcaggcaggtggaagatatgcttgaaggcgcgggaataccgaaagaatcgcttttctttacgtctgtcactgagcctgaccatcctttaaacggcatggaacagctgaaaaaacatctgcagaagctgaaacagcaggcaaaaacaaatttatggtccttaacggagagaaaagtcgcacacttagtcaaagagcatacagagatgctcgtaaaagatgataaaaacggaagcggagagcagtttgacaaacaagaagcacttgtccgttctgttgaagatgagcttaataaagccgttcaacaggctgaaacagcagagaaagacatcagaaaagacgtgcagaacatattgcaaaacgctaatttgacaccctttgagatgagggagcttgcatctgcttatattgaatcacagcagccctcatttaaaaccggattattcttttcaaaagcgaaaacggctcaggagaaagagagaaggcatgctgaattttttgccgatattaaaaaaagaacggaaggggaagcggattggcacattatcgacacatttacgaaagcggccaagcggtatgaagcggattcggacgaactgatcaagaaaatccaggcgtaccgcacaccgctttctgatgatatcaccgctcaggcccttaagcagggagcggccttttcatctgaatacgtattaacttatacgaaagacctcgctgagatgatcagaagggaagccaaaagacagacagcggaactcattgagaagcttaccgcttatgttcaggcaaaaaacggaccgctcattgagaacttgaaaaaccggctcgaaaaagaaaagaagataagggatgagctcgcgcaatcggcaaaagaagaacgcaatgccttggaaaaagcagcccgggtccgcgctttgtgggaagaagaattgacctgtgatacgggaagcggcgactggtatacgcgaaaaaaacgccttgcaaaagcgcccgtccaaaaagagaaaccaaaagagactgtacagtatgaagtaaacaaacccgaaaaaaatgcgatgaaggaacttcctataaaagagcagactgatcggttctatgagcttgccgggattcttgaatcctcgagcatattaggaaaacaggcagaagcctttcgaagcaggattgagcggcttgaaaaccgccagtttaccttggcgttattcggcggattcagttccggtaaatcatcatttgcaaatgcgcttgtcggtgaatacgtgcttccgtcatcaccgacgcccacaacggctacgattaacaaaataacgaaaccgcaagccggcaaaccgcataaatctgcggagatcgtttttaagacggaggaggatctggacgctgaaatgcttcagctgactgagctgaaagacgctgatgtaaaggggcgttcactgaaagagagatggaattatgccattaaaaaggggaaagttccggatgaacttatcccggtgattcagacgatgctgcaggcgtttgatacgtatgaagaacagatccgtcaaaggcagacactgacggtgccggtggaagatttaaaaccgtatgctgccgaagaaaaaacggcctgctgcgtaaaagaagtcaccgtgtattatgattcgcctctcacgcaaaaaggcatcacaattgttgatacgccgggagcaagcagtataaacaagcgccatacggaacttgcctttcaatatataaaagatgctgacgcgttcttttatatgacgtactatcagcattctttttcaaaaggagacaggtcttttctgaagaaactcggcctcgtcaaagaatcattcggcatggataaaatgttttttgtcattaacgccgccgatctggccaaaaccgaaagcgagctggaaaccgtcaaagactatgtccgctcagaactctcaaaagagggaattaaccggccaaaattatatcatgtctcaagtaaagaagagcttgcgggtaaaaaagcagctttttataacaggttctctgatgtaagaaccggacttgagcactttattgaggaagatgtaatgagggccagctgcgcccagctgaaaacagaggcggacaaattgtgcgatatggtggaacagcttcacgaatctcttcaccagtcggcagaagaaaaagagaaaaagaaacagcatctggagtcttcctatgaaaaagctctcgctgacatttcaaagcgccgtacgtctgaggtcatcattcgaaaagtgatgaaagatacggaagaacagctctatcacattaaacatcgcctgacattttatgcgaatgatatgctgaaaaccgccttccatccgggccttcaaaacggcgattggaaacaaaatatagcagcggcgctgaatgaagcgctcaaggaattccgttttgaatatattcaagagctgaaaacgctcgatatccggatgaccggttttattgagcgccatatgactgaggaatggatggaaaactgtcagaagaagcttatggaagacggagatttctccatttatgtgagcgccgaaaacgaatttgccgttcagctgaaagaagtcgctccggtcattgacgtctcggcattcacacatcacataaaagaagttaaatcgccgaagcagttttttgaacagaacggaaaagcagcgtttgtagaagggctcaggctcagcctgcaaaaagtgacagaaaagtggcttgagcaggagaaagaaagcctttcagagcgatatactgagcaggtgcgccgtctgcaagaagacatggcggataaaagcctgtcccagatccgcgagcagcgggacacttatttacaaggtcttgcggaaaatacgagtgcaagggaaattgaacacctttacgaagccgaaaaagcatggaaaaagaaagatgaaatgctgaaaatttaaaaatccggttggcgggcagataacagtcgtggtagactaaaatgaaaaaagcgagatgaaaccttttatgtcagaagtccataaagcaatttcagcacattccgcaaaacagcatcagcacgtcaaaacatttgtacagcttgactaccagcgtgaacaggccattgaagaagccattgtaaaatgcagacagaatgaaccgttcacgacagatgccatcaatggcattaccgcaaaaatgaaccagctggcgaaaaagggcatcgtgccgcaaagacgattcgtaagtgaagagatggtgaaagaattcgtcagcagacagtaatggatgaacctgccgcgtgtgtcatcagcgcttgctgtacatactatccgtatcttctctaaggggggatatgacaatgggcagaacaaaactgggaaacagaaatgttcagcagaataacaatgccaaaaagaaaaacggtttcggacagaaatttgattcttatgccggccgtgaagctgaaaagctgatggcaagcaataaaagacacggtgagtaacgtgacggcagcatcttccaaatggggggatgctgtttttttaccgccttctttggtaaaataggaacattgaataaaaaaaggagtttcgatatatgaataacaaattactgctcgtggacggcatggcgcttttgttccgctcgtttttcgcgacggccgttcatcgcaattttatgataaatgaaaacggaatcccgacaaacggcgtcaacggttttttaaagcatctcattacggcggttgatacgtttcagcccacacatgtcgtctgctgctgggatatgggaagcaaaacgtaccgcaatgatttgtttcaagattataaggccaacagaagcgaaccgccgcttgagctgattccgcaatttgatttagcgaaagaagcagcgcgagagctcggttttttaaacatcggcataaaaggctatgaggcggatgactgtatcggtacgctttctgccctattttccggagaagcggaaattacgattgtaacgggtgataaagatctgcttcaattgatgaatcatcaagttcaagtagcgctgctgcaaaagggtatcggcaattataaggtatatacagatgagatattcagagaagaaacgggggttccgccaaaagcgctgattgacattaaggcgctgatgggagacacgagcgataactatcccggcgttaaagggatcggggaaaaaacggcgtacaagctgatccgtgaatacgaaaacatagaacggttattagaaagcctcgctctcttgccgaagggccagcaaacgaaaattcagcaaagcttgaaagaattggagctgtcaaggcagcttgctgaaatacattgcgaggtgccgttagtctgtacgcttgaagaagcgattttttcattgaagatggaagaagcatccttaatgctcagacgccatcagataaaaggaattgaaagaatgctcgaaaagctgaacgccagagagatcagctgatccctctagcgttttgtattgcttttttttgcgttgttttcaagggctgatttcgggtctttatgcgcatttccttccatatttccctgaggattcacgcccccggtctgccggcctttattttcttttctcatagctgttcacctcatttgtaggatgaacagtgaaacgcaatttcattccggttatttattcagccggaccgctttttttgcgagctgatcggctgtttggttttgtctgccgggaatccacttaatgaaaaacaatggaaatccggcctttaagcggatgatttcatccacaaacggctggaaagccttgtttttaaccgcttcaagttccgcggcccgctccacgatatctgaatccgtccggaatgacacggactcaaatccgcgggcggcacacagcttcattccttcaattaaagcgagaaattcagcttcctgatttgaatggtcgccgatcggaattgagaaagattctgttttcccgtcatgtttaataaaaataccgataccggaggggcccgggtttccggcgcttgcaccgtccacgtaaatttcagcaggcatcatccgtcactctcccttcggtgtcattcgttttgccgcatacgcataagggacagaaatgagtgataccgcaaatttaatcaggtaagtcgaaataaagatgctgaaccatacgcccgcggaataaacgccgataaaggccacggcagtgaagataaatgtatccagcagctggctgagcgccgtgcttccgctgtttctgagccagagaagcctgtctgaaggaaagattctccgaatggctgaatatacataaacatctatcgtttggctgaaaataaaagccaagaggcttccgagtgcaacacgcggcagaaaaccgaaaatcgtctcaagggcaggctgcgcgatatctgacgcagccggtttatataaaagagccccctgcatggcgcatgtcaaagcgagcaaagtggaaaagccgagccagacggctttgcgcgcttctctgggaccgtatttttcattcagcacatccgttgcgaagaaaacggtgccgtacatgatatttcccagtgtcgccgtaagcccgaacagctcaactgttttgacaacctgcaagttggcgcacaccgtggcgaaaccgatccatacgaataggcccgttttgccaaatcctttataaaacagaagaacaatgataaaatgaatgaccgcaaataagatccataacacatcgttaaacaaaacctgctgacttcctttcaatttgagaatggtttgattatagcacacgcccgtcaactaatgaatggtaaggtgatttcaatgaatcttaagccgtatatcgaaatagaagcaaaaggaacaggccctgtcgcgtttttttccgaagattggctgaccgttccgaaagcgcgcatgcttgcaagagaagtcagccgctttccttatataaaagacatttattttgaggatgaaaaaggcgcgagctggacgcttaaagaattagaaaagcttactgaagaacttgcgtacgaacctgacgacattacagtgtatttcgacggcggctttgacaaaacaagcggacgcgccggactcggaattgtcgtgtattattctctcggcggcaagcggcatcgcatacggaaaaacaaaagcttaacgcttcagacgaacaatgaggcggaatatgccgctttgtacgaagcgcttaaggaagtgcaggaacttggcgcaagcagaaattcaatcacgataagaggggattccctcgtcgttttgcatcagcttgacggcagctggccgtgttatgatgaaacgcaaaacgaatggctggataaaattgaagcgctgctcgaatccttaaagctgacaccgacatatgaagccgtaaaccgaaaggaaaatcaagaagcggatgaccttgccagaaaaattctctcggaccggcagattgaaagccgcataacattagaaggtaacggagatgactgatattggataaaaaaagcatttataaagaattgacagagcttcaggatgaatattgcaaagactgtttcgtaaaaaagcatttccgcaaagagtttggaaaaacgcacgctcattctttctgcatcaaccaatgcacggtgggggagaagctgaaagcctacggcaaggtgctgacaaatcaataaaaaataaaaccgcagcttctgcggttttatttttcgaattcatcaagctgatgctggcaatcgtcgagaagcattcgctgcttttgcagaaaatcctggtcgagagcttgcagttcactggattgtgacatcgttctggcatcctgaatcgcctggtaagcagactccaccaaagttgaactttggccccgggtagccgctcccgttgttttctgggccgtttccaccgctaattcaagctggcgtttatccgtcagtccgtttggaaaaaattcagagtccattaaaaaacacctccgcaaatagtttggagattttttttagaaatatgtacggaaaatagaaaaaaatatagaaaataagccgatataactattgaacctgattaattagggcttatttactattattcagggtatcttgggagagaagggaaaaaccagccgtgaatgataatgatttaaaaacaatccttcagcagacatttaaagaaatatacggtgatctgggaagtttagcggaaatggcgaaaaaaggaatgccgtcaatggagaaacaaattgaagaaatcgagcagcgctgtaagcagaatcttgtcgcaattgagattcagacggcaatcaaataggagaggcatacgcctctcctctatttgtcatctgatcaacatgtattgagtttagagttttacaacattagaagcttgaggtccacgattaccttcgacaatttcaaaagaaacttcttgtccttcttctaatgatttgtatccttctccttcgatagcagtgaagtgaacaaatacgtcgtctccgccttcaacttcgatgaagccgaatcctttttcgttattgaaccattttactttaccgttttgcatattgcttaattcctcctagtactgtagcaccttcgtgctaaaaaaaattttgtcatcatccaaccgtacgtatgtaaacgttgttaaatgatggttcaactatacaccatatgggagcgggcgtcaagcggccgctccctattttttatctttatttttccagtaacaaagcttaaccggaaaaaaacaaaaagcacacgaatcgttcgtgtgcttttcttttacgataatgccatatccgccttcccggccatcatttcagattcttttataatgtcctgcaaaatgacttcagaagagttggggaggtgaaggcttttaatattgctcttcatccggttcagcttctcctcatccgcaagaagggaggtgacagactctaaaatttcttcgtggcggttgaccacgacagccgcaccgcgatcttcaaagaaaatggcgttttccttttcctgtccgggaaccggtttgtacaaaataacgggtacgccgatcgccgtcgcttccgtcagtgtgatgccgcctggttttgtgatcatgcagtccgtaatacggaacagctcgtcaattctttctacataacccagcactttcagccggtcggcattgtcaccttccaagctgctgagggattctttcagcgagctgtttttgccgcataccaccacaacctgcacctgatcgtcatgaacgagattttcgcacagttcttttacgtttttcagcacaccatgcgctcccgccataataagaagaacttttttgtcgggagagagattgtattttttataaatcggctctttcggcatcgattcctcgaattgaggcctgatgggaatgcctgtgatctttacgttgttcgggtgagtgccgatttcaatcagtttttcctttacgtaatctgtggcgacataatatttatcaacattttcatgaacccagattttgtgaaggcagaaatcagtcattacgttgaacgtggggatcacttttccggttctccgtctgtattccggtacgacaatcatcggaaatgtattgataataatgtccggcttatgctcttcgacgagctggcctaaacgtttatttcccattttaaaataaatattgaatttgcgtttattatagattttgtcaactccgtaataaaacaaacgataaaactgtttcccgattgagaagctttttaaataaaggtattgagtaacctctgaaacaatcggatttgactcttgatacaaattggaaaccgtcacatctaagccgagacgcagacattgttcgtagagcgttttggccacttgaacatgcccgtttccgtaatttgcagtcaaaattaatacttttttattggtattcaagtaaattcacctcaatgtaatcaacaacaagcaagcttcatgcatcgtaaggagttattgtctatagataaacataacacaagtgcatcattttataataagcgcgccaacatatttaaactaaatttaattgatatgttccattattttaaagttttgttatacgcatactgaatcaagagtattttatcatatttttgtcaccgtatcacttaaaacaaaaattaatcccattcatacggagtttcctgatatacgtaataattcagccaattcataaacaataacgttgcatgagctttccagcggttaacaggttctttcccgccgggcgcaaaatagtgcttaggagcttctacgtttgaaagatttctctctatgtctctctcatactcctgaagcagcgtatcggtatcatattccggatgacccgttaagaaaatctgtttttcgtcttttgaaacgattaaacagacccccgcttcctctgaaacgctgagcacattcagatccgaagccgattgcagctgctccgtattaatatctgtatgccgtgagtgtggcacatagtatagctcgtcaaatcctcttaccaatctctcatgttttttaagaacggtatgctcaaacacaccgaagatttttttcggcagctccactttctcaatgccgtaatgatagtataaaccggcttgagcgccccagcagatatggagtgttgaagtgacgttcgttttgctccattccatgatttccttcaattcttcccagtaagaaacatcctcaaacggcaggtgctcaatcggagccccggtaataatcattccgtcaaaccgtttgtggcggatgctggaaaaatccgtataaaattcatccagatgctgccttgccgtattttttggagtatgtgtgctcggaattaaaaacgtaaagtgaacttgtaaaggtgaattcccaagcatcctgaggagctgggtttccgtttggatttttttcggcatcagatttaaaatcacgatcttctgcggccggatatcctgatgaaaagcccggctttcatccattacaaagatgtgttcactttcaagcacctgcttagcgggcaggtgatttggtatattaataggcaacatgccacctccgttattccccgttaattttcttcattatagaaatttttaagccatttttcaatccatcccggcgtaataaaccgtatttaacgcataatgacagggataaaagcggcaaatgggtataaattcggagcggctcttttattatgacgggtaaagagccgtttggttcctcgaaaaaaacgttttccgttaagtggaaggaaaaagcggttaccgtttgttttgcagtgtaaaacaggtaaaataaatgaagaatgtaaaaaggagggccgcagatgacaatttacgatataaacgtacggaccataacaggcgaagacatgacgctatcggcttacagaggcaaggtgatcatcattgtgaatacagcaagcaaatgcgggttcacatcccagctcaagcagcttcaggagctctatgatacatatcgggaggaaggtcttgaaatattgggatttccctgcaaccaattcatgaaccaagaacctggaaatgaagcggaaattcaagagttctgtgtgaaaaactacggagtcacattcccgatgtttgcgaaagttgatgtcaatggggcagacgctcatcctctcttcaaatatctgacggaacaggcgaaggggatgctcggcacaaaagcggtcaaatggaatttcactaagtttatcgtggaccgaaacggtgaagtcaacgggcgtttttcaccgaacgtcaacccaaaagagcttgaagatacggtgcagaggcttttggcccgataagaggtgatacggtgaacgaaaaagagcagctggaaagcgtcaggaattgggtcagagaaaagcttatcaatgaacgtacgggccatgactggcttcatatttcccgggtcgcaacactttctgtttatatggcaaaagaagaaggcgccgacttatttatcactgagacggccgcgctggttcatgatctgattgacgccaagctcgaaaaaagcgaaaggctgacggcaggcgaagtgacagaacggctggctgctttcaacattgcggctggctccattgaggagatcgcggatatcatcacgagaatgtcattcagacacagggaactgctgataaagcggccgctttccttggaggggaaagttgttcaggatgcagacatgcttgatgcgatcggcgcagcgggcatcggcagggcttttatgtttgccggcgcgaagggtcacccgatgtacggaactcaaacaagtgtgctggcccatatagaggataaattaatcaagcttaaaggcttaatgaatacaaaagcgggggcgggtttagcagaggagcggcatcaatttcttttgcagttcgccgcccgtatccaaaaagaggccggcatcggcaaaagctaagcggcgcaatagaacgcttgtgccgactatgttagaataagtgtcagattgcgcataggaggaccaatatgaagattaaatcaatagaaccgacgccgagtccgaacacgatgaaagtgattttgactgaagagcttccggcggggaaaagcaacaattacaagcctgatcaggcagatgatgctccggccgtcgtacgtgatattttaaacattgaaggagtaaagggtgtttatcacgttgccgatttcctggctgtggagagaaacgcccgttttgactggaaggacattctgcctcaggtccgttccgctttcggaatggaacatacggagcagtctgagagccgttctgaacaggaatcgttcggtgaagtgaaggttttcgtacaaatgttcagcggaatcccgatgcaggtcaaattgacggacggcgaacgtgaagagcgcttcggccttccggaacgtttccaagaagccatcttaaagctgcgttccgaagcttcaaatgttgtatttgagcgggcttggaaagaacaaggcgtgcgcttcggggattttaccgaaatcggacacgatgtcacagaagagcttcaggccgcctacagtgatgagcggctcaaacgcctgacagaagcagccgtacagcaaaagggtgaggccaaaccggcagtgcagcggaaagcttataaagtgactttggaaatgctcgatgatgaagactggaaacagcgctatgcccatcttgagcaaatggatccggatgaagacgatttaccagtattagaaaaggcgctgcatgatccgaagacttcgatcagaagacaagccgtcgtttatttgggaatgatcgaaaagccgtctgtgcttccgctgttatacaaagcgcttgaagacaaaacggtgacggtcagaaggacggcgggtgactgtctgtcggatctcggcgatgcgagcgccatcccggctatgacgaaatcgctcagtgactcaagcaagctcgtgcgctggcgcgcggccatgtttttatatgaagtcggcgatgaaagcgcactggaagcattaaaagcggcggaagacgatccggaattcgaagtcagcctgcaagtcaaaatggcgattgaacggattgagcacggagaagaggcgaaaggttcagtctggaaacagatgactgaaagcagaaaaaaagaacagttataacaaaaaggtgcgccatgcaccttttttatttgaattcactttttataaaaattatttagaatattgttgaaaaatgattcaaaactctatatagtaagtacaatattaattgttggagggtttttatcgaaatacagaaagaatagaaaagcgagacagggcaaagacgctgtaaacaggtaatttgcagaacgcgccctagaataaactgaaaattttaaaaatagtgcacagtctaaaaacagtagggggatcaccatggcagaattacgcagcaacatgatcacacagggaattgacagagcgccgcaccgcagccttcttcgcgctgccggcgtaaaagaagaagacttcggcaagccgtttatcgcggtctgtaattcatacatcgatatcgttcccgggcatgttcacctgcaggaatttggaaaaatcgtaaaagaagcaatcagggaagcgggcggtgtgccttttgaatttaacacgatcggagtagatgacggaatcgcgatggggcatatcggcatgagatattcactgccgagccgtgaaatcattgccgattcagttgaaacggtcgtctcggcgcactggtttgacggaatggtctgcattccgaactgcgacaaaattacgccgggaatgctgatggcggctatgcggattaatattccgaccatttttgtcagcgggggccgatggcagccggccgcacaagcgacggccgcaaaatttcgctttcttcagtatttgaaggcgtcggcgcatatcaagccgggaaaatcggtgaaagcgacctgcaggagctggaacagttcggctgcccgacgtgcggatcttgttcaggcatgtttacggcaaactccatgaactgtctgtctgaagcgctcggtctggcgcttccgggaaacggaacaattctggcaacttcaccggagagaagagagtttgtgagaaaatcagcggcccaattgatggagaccatcaaaaaagacattaagccgcgcgatattgtcaccgaaaaagcgattgacaacgcctttgcgttagacatggctctcggcggctcaaccaacacagtgctacatacgcttgcgcttgccaatgaagctggggttgagtactctttagaacgcattaacgaagtggctgaacgggtgcctcacttatcgaaattggcgccggcctcggacgtcttcattgaagatctgcacgaagcgggaggagtctcggcggcccttaatgaattggcgaaaaaagaaggggcgcttcatcttgacgcgctgactgtaacaggccgcacactcggagaaacaattgcgggtcatgaagtaaaggattatgacgtgattcatccgcttgacaatccgtttaccgaaaaaggcggtttggccgtcctgtttgggaatctggctccggacggcgccattatcaaaacaggcggcgtacaggacgggattacaagacatgaaggccccgctgtcgtctttgattcccaggatgccgcgcttgaaggcattataaaccgcaaagtaaaagaaggagatgttgtcattatccgttatgaagggccaaagggcggaccgggcatgccggagatgcttgctccgacgtctcagattgtcggaatggggcttggcccgaaagtggcgcttattacagacggccgtttttcaggagcgtcccggggtctttcaatcgggcacgtatcacctgaagcggctgaaggcggcccgctcgcattcgtagaaaacggcgaccatgtcatcgttgacatagaaaaacggattttggacgtacaagtgcctgaagaagaatgggaaaaacgcaaggccgaatggaaaggcttcgagccgaaagtaaaaacaggatatctggcccggtattccaaactcgtaacaagcgccaatacaggcggaatcatgaaaatataaaacagaggcctgaacaattgaattccggccccctctatagtatccttgacttcatataaggatttttagagggggcttttttatgtcaatggcttatgaagaatatatgcgccagctggtcgtgccgatgcgccgtgagctgacgggtgcgggttttcaggaattaacgactgctgaagaagtagaaagctttatggaacaggcagagggcacgacattggtcgttgtcaactccgtgtgcggctgtgcagccggtctcgcccgtccggctgcgactcaggctgttttacagcatgaaaaagcgcctgatcatacggttaccgtatttgccggtcaagataaagacgcaactgcaaaaatgcgtgaatattttacggggcaggaaccttcctcgccatcaatggcgctgttaaaagggaaagaggtcgttcattttattccccgccacgaaatcgaagggcatgacatggaggaaattatgaaaaatctgacggatgccttcgatgcgcactgctgaaatgcccgaattccgggcattttctttttggagaaaaagatgatcacaacgagttacagaccaagcgaatacacgatacacacagcgcagtcactcagtgtcaggctgggtgacacttactgcagccgcaataaacagcccattgaaaaaatgctggaacgagccgctagcgatcttttagtcatcggaaaggaacggttcgaactttacacgaagcaaggggagaagttcttttttcacccgaatacagcgatgttccgcgcaaagcggtttttgagaggggaagccgagccgttgttaaaagcagccggattacgcgagggggattcctttttagattgtacgctcggcctggcatccgatgcgattttggcaagcctggcagtcggaaaaagcggacaagtcatcggcctggagaaaaacaagcttgtctcattgcttgtagaaacaggacttcaaacgtgggaaaccggaatggagcagctccaaaccgccatgaaacgcattcaggttaaacatgccgactgcgccgattatttgcgggagcttcctgattcatcggtagatgtcatttattttgacccgatgtttcacgaacctgttgaaacgtcagacggcattgcaccgctccgcgcgctggcagaagagggttttaacgaagagtgcatcacgcaagccgtccgggcggcgaaaaaatgcgtagtgcttaaagaccattggaaaagcccgcggtttgaacgatacggcttcaaggtgctgaaaagaaagacggcgcttttccacttcggtgtcatccatgtaagctcatgatatcatgggcttctttttcgttaatcagtgatttccataacgacaaaataaagcagcgtgagaagtgatacagtcgcaaataaagcgttaatcatctcatcccctcctttttctccttcttattgtaagcggtttatccactcggtcacagttaccaatttcccatattgcatgataatacggtgccggacatgacgccgcgctttaatctatgctaaaataaaggaaaagaggacaataaaacagaggggaacaatctatcatgaaattgtggatgaaaaagacccttgtggttctgtttaccattgtaacgttcggactcgtgtctcctccggctgctttgatgacagacaagccttcaggacagtcgagcagtcttgagcagaatgattacaccgctttttatgatgaacacgccctgacgggagaagcgaaggcagggcgggagcctgaattactgtttcaatcgtatcagcagcagcttctcggtgatgctgaaaatcaatcatttttaaaattcggcagcaaaatctctccggtcattgaagatgattacagaagtgaaattctgccgaaaatcgaagatgtcatcacaggacatttagccaagtttcaagatgatgaagcgtatcaggatgtggttatttccagtaaaccgtcggccggaaaaactgaaaaaatttttcatgtgtataacaggctgacaggtgaagatcttttaaggttccacgtccgccgggatcatcctccgcaagacggctactggtttaattttcattaccataccgctgaagacggatttcaatcacatcatgagctcggcagcatttactgggaccgcaatacgccgcctgactggatgagcgtgtaatagcgagaagaaataaaaaaatcatttctgagaaattttgcagaaatgattttttattgtgttacactactaaaagactactttaaaaggatgaaaaaaatgaaacaatataaagatttgtgccgtcatgtgttagaaaacggagaaaaaaaaggagaccgtacgggaacgggtacgatcagcacgttcggctaccaaatgcggtttaaccttcaggaaggtttcccgatgcttacgacgaaaaagctccattttaagtccatcgcgcatgagctgctttggtttttaaaaggagatacgaacgtccgctaccttcaggaaaacggagtccgcatctggaacgaatgggcggatgaaaacggagaactcggaccggtttacggctctcaatggcgttcgtggcgcggagcggacggcgagaccattgatcaaatctcccggctgattcatgacatcaagacaaacccgaattccagacgtttaatcgtcagcgcctggaatgtcggcgaaattgatcatatggcgcttccgccctgccactgcctgtttcagttttatgtcgcggacggaaaactgtcgtgtcagctttatcagcgctcagcggatgtctttctcggcgtgccgtttaatattgcgtcttatgcgcttttaacaatgatgatcgcgcatgtgacgggacttgaaccgggtgagtttgttcatacattcggagacgtccacatttaccaaaaccatgtggagcaggtgaatttgcagctgacaagggatgtccgtccgctgccgaaactgcggtttgcgcgaaatgttgattctatttttgattttacgtttgaagactttatcattgaggattatgacccgcatccgcacataaaaggagctgtcagcgtatgatttcgtttatttttgcgatggatgagaaccggctgatcggaaaagataacgatctgccttggcaccttcccgatgatctcgcatatttcaaaaaagtgacgacgggtcacaccattgtaatggggcgcaaaacgtttgaatcaatcggacgcccgcttccgaaccggcggaacatcgttgtaacctcacgggacgaatcttcattcccgggctgtattaccgccgactcggctgaggaagtgctcaagctgatcccggcggatgaagaatgctttgtaatcggcggtgcccagctgtacagtgcgctctttccctatgcggacagactttacatgacaaaaattcaccatgtctttgaaggagaccgtttttttccggaatttaatgaagctgaatgggaattgacctcccgcaaacagggagtaaaagatgaaaaaaacccttacgattatgagtaccttgtatacgagaaaaagaattaagcagggggacaagaattgattcgttacggctgccttgtgatgtacgttgtatttatgttcatgaaaaatattcaggaatatatcaatcaaaaagagcttgacccgcggctctcttttcaaaaacagatgaggctggtgtatgagcggccgaaagcctttatgagaggctgcattgacgtgtcgggatcggcaatcggcattcatcatgatcagccgataccggacggccccgtattgtatgtgcatcccagattgcgcccggctgatcttctgctgcttgcgggacatcttgaagagccggctggttttatcgctggcgagaaagctttccggatgccgtttctcggaaattggctgcgtctgatgggtgtcatttgtggcggagacagccgggatgcagtgcttcaggaggcggaagtccggctgcaaaaagggcaaagtctgattctgtccgaagacggcaaaatcaatccggaggaactggcccttcgtttcgatctcccgattgtgcccgtcagcacttcgggaacagaccggctgctgcggggcaggttattgaaacggctgaaaccggctgatattgaattacatataaagcccgcttattatccggccggtcagaaacggctccgtgcataaaaaaagcacagtctctatacgagaggctgtgcttttttatttcagataaagggaactttgacgcaataaaacaaaatacagaaaaacatcgaggcgctgccgcctaaaacaaaactgtgccaaatggcgtgatgatacggaacttttctccaaatataaaatattgtgccggcggaatacaataagccgccgaaaagaagaaggccgaaaccgggacctgacagcgaagcgtacagcggtttaatggcgatgatgatcagccagcccatcattaaatagacaagcgttgaaaaaatgataaaccgcttcacaaaaaagattttaaacacgatgcctccgatggcaagcgaccaaacaataattaaaagggtcagaccgagcgtccctttaaggggtcctaataaaaatggcgtatatgttccggctattaatacgtatatcgcggaatgatccacaatttcaagaatgtctttcgtttttttatgctggatgctgtgcaaaagagtcgagctgagatacagcaggagcattgaagcgccgaatatggaaaagctgacgatgtctgtcggcgagccgtatttcaccgcaaagataatgagaaaaataagcgccggaatcgacagcaatacaccgattccgtgtgtgacggcatttgcgatttcttcttttattgtgaacaatcaaatgtcctcctttttaaaggatttgtttttgcagtgactgcaaaaaggtcaacccttctaatgtgatttttgttcctgcgcgtcctcggccttttgtcacatagttcatcttttctaagtaatcaagcctgtttctgacttgctggggcgttaatgtcattgtgctgttttcgcttaattcggatatgctccgtctgctggcgggttcgccttttgtatttaagtctttaattgcttccaaaataaacaaaaactcttctttctccatcaatgtcagccgtttttcttttttcttagcggttttcgctttctggctgtttttgatatacggcgggacatgctcgggataaatcgtgctgccggatgctgccgcggccatatagtgcgccgcattttcaagttctctgatgttgccgttaaaggtgtgccgctcaaacagcggataaacggacggatcgatatgaacatgctgccccgaggctgtcagcatatgctgcagaagaagcggtatatcgctttttcgttcagataaagcagggagcggaaggcctaacacgtgaagcctgtaaaataaatctatgctgaacgtgttttccgcgccggtatcgccaagattcgccgtgctgcttgcaatgatgcgggcggaaagcccggcgtccagctcggaaagaaggcgggcctgtaccgagagcggcatgtctccgatttcatataagaataatgttccgcggcgggccctgtttaatgcgccttcagccccgaacagttcatattcgagccgctcttcgctttgactgcagtgaacggtaataaatagttcgctgtttctgcgggatttatgatggatcgctctggccatttgtttttttccggttccgacttcacccgttatgaagaccggcaaatcagataaggcaaattgcgaggccaatcgtttcgcttctgaaaaggtgtgatgttcgccggctagctgataaaaaggatcagtttgttcaattacactcataaattggctccttttggttctaattggtttaagtataacacgtttatgcgatcgaaaatatctttttctcttgtatcggttcatttatttttatttacaaaattaaaataattatcttattgtttgaatattcatgttataatggcatattaaatagggatttaaataagaaaggactctgtaaatgaaaccgttgcttaaagaagactctctcatccaggtaaaagacattttaaaagcgcaccaaaacgtaaaggacgttgtgatacatacgcctttgcagaggaatgacagactttctgagaggtatggctgcaatatctatttgaaaagagaagacctgcaggtagtcagatcatttaagctcagaggggcttataataaaatgaggcagctctcaaaagagcagactgaaaacggaattgtatgcgcaagtgcgggaaaccatgcgcagggggttgcgttttcatgcaaacacctcggcattcacggcaagatttttatgccgtcaaccacaccgagacaaaaagtatcccaagtggaactgttcggaaaagaatttgttgaaatcatattgacgggtgacactttcgatgatgcgtataagagttctgcggaatgctgtgaaaaagaaaaccgcacgtttattcatccgtttgacgatcccgatgtcatggccggacagggaacggctgccatcgaaattttaaatgacattgacgtcgaaccgcattttctttttgcaagcgtagggggaggaggactcctgtccgggatcggcacgtacatgaaaaacatctcgccggatacaaaaatcatagcggtagagccgaagggcgcagcctcctattttgaatcgaaaaaagccggacaagtggttgaacttgagaaaattgataaatttgtcgatggggcggccgtaaaaaaaatcggcgctgaaacctttcaaacgctcgaaaccgtcgtcgatgacgttttgcttgtcccggaaggaaaagtgtgcagcacgattcttgaattatataatcaatgcgccatcgtggctgaaccggcgggtgcattgtccgtgtcagcacttgatctgtacaaagaagagattaaagggaaaaacgtcatctgcatggtcagcggagggaataatgacatcggcagaatgcaggagatgaaggagcgctccatgatttacgaggggctgcagcattattttatcgttaatttcccgcaaagggcgggagcgcttcgcgaataccttgatgaggtgctcggtcctgatgatgacatcacccggtttgaatacacgaaaaaaaataacaaaagcagcggccccgcattggtcggcattgagcttaagcatcgggaagattacggcgcgctcattgcccggatgaatcaaaaaggatttcattacgtagaggtgaataaagatcaggatctgttccacctgttaatctgactttttttagaacggccgcgcaaaatgacagacacgctttctcagattgtatataataaaaagaaaacaatcgaaaaagaaggattgatatcttgttactcaaaagcctagagttcaaacgacaggacgggattcaggtaaaagtgacagaaataccggttatcacggaaggtgaacaatatttttttcaaattcatcagcaccttgagctttatttgagagaagtttttgcttcacaaagtgtgagaacagtgtattcattccgacaatatgtcaagcgccgtatgaagtggaaagattatgaggccgttttcagccaagagattttaaaacataacgcataacggtgcacattccttagcgccttccttttgataagggagggtgcgggaatttttttatgatgaacgctgtaagcgttttatctatgggggaatggaaatgaaaaaaatgaaaagcttcgctgccgtcttttgtttgctgctcttgtgcgcctgcggggggaaaacgataaaagacccgctgaactatcagattgagccgttttcatatcagaaccaagacgggaaaacagtgtcactgaaaagcctgaaggggcatgtctggattgccgattttatgtttacaaactgtaatacagtctgtccgccgatgacggcccacatgaccgaactgcaaaaaaaactgaaggctgagaacctggacgtgcggattgtgtcattcagtgtagatcctgaaaatgatacgccgaaacagctgaaagcctttgcttccaaatatccgctttcgcttcgcaactgggattttctgaccggttacagccaaaaggacattgaagattttgcgctgaacagctttaaagcaatcgtcaaaaagccggagggagaggatcaggtcatacatcaaacttctttttatttagtcggacctgacggcaaggtgcttaaagattatgacggcgtgcagaaggttccgtatgatgatatcctctcagatgtcaaagcggctgaggagctcaagtaaactggcagattagacattttcaaaactgaaaaaacatgttacactttccactagtagacggggaaggagcaaccagattgaagctgcgaatgttctcattgatcgccggactggctttgcttttatcagcttgttctgtccagcgcaccggttctgacgctgaagaaccgaaaacgaaagatcatattgtcatagctgcggtcggtgattcattgactgaaggagtaggagatcctgacggttcaggatacgtcggcaagacagcggagtctcttaagaaaaagggacatgtgaaaacggtagatattaaaaattatgcggtgcagggcgacaaaacgtcagacctgctgaaaaagcttgataataaaaaagtgcagaaatcattaaggagcgccgactatatcttttttaccatcggcggcaatgacttaatgaaggtgctccgccagaatatgatgcagctgacggttcagccgttccaaaaggaagagaaaccttttgaaaaacggttcaagacgatcatttcaaaaatccgcaaatataatgaaaacgcagagctggtgtatgtcagcatgtataatccattcacgtttacgctgcctgaattaaaagaaattaatggggttgtgacggattggaacaagatcgccgcaaaagagctggaaaaagatcctcacgccgctgcggtgaatgttgaagacttgttcagtcaaaaaagcggcagcagacggatttcaaaggatgatgattttcatccgaacgcaaaagggtatgcactcatcgccgaccgattatacggcatcatagaaaaacaagggttaccagcagaatagggtgaaatgatgaaaaaatggaaatcgctgttttttgttcttctcgcactcaatgtgattgccgccgcggtaattgtgacattattggttatgccgggagaacaggcgaaaatacaagatcagacaaaaagtgagtacggctttcatatcacaagctccaaagaatcacttgccaggtttgtgaattcgtacttaaaagagaaggcatcgaatcagcttgactacaaagtggacatcaataacgatgtgcacgtggcaggtaaaatcaaagcattctcaacctccattaacgcggtcgtcacatttgaaccgtccgtacaggagaacggagatgtggttttgaaagtgacgaagttttcattaggtgaattaagcctgccaatcagctttgtgctgaattatatggacagcttttatgaactcccgtcatttgtgcacgttcattccggggataaaagcatcgagatccgtctgtcagaaatgcctttagacaacggcatgtatgtaaaagcggataaaatcaatctcgacacggatgaaattgaattttcctattatcatccgaaacaataagttttcataaaaaaaacacagatcctttcagggatttgtgtttttttgtgtcagcgttttttgtctagcttgctgaacagtttgattaacgttgcaagctcttcatcagagtagcagtcaaaccgtttaaaaaagtattctgtttttttctggttgaaatgatcgacaattttctccccggcttccgtaatatggattctgataattcgcctgtcctctttagaacggatgcgggtgatccattccttttctactaaagcatcggtcactgcggtaatgtggcttgcggagacctcaagaatgggggcaaattccgttacttttttaggcccttgttcactgagaatccgcaaaatggtgaattcgttcctggacagctctttatctagaatttcattaacttcatttctgatttgtttaaacacttttcgaagcaaagcttccatatcatacatcatttgtgtccttactttcaaatcatgaacctccaatatgtagtcagcgtggcattcgttcagcttctcctgagagcagaattatttttattctgtttatacatgctataatataataataccacgtatgaacaaaggagggcacccgtatgtcagaaaaaaaagaaatcgccacatttgcaggcggctgtttttggtgcatggtgaagccgtttgacgaacagcccgggattgaaaaggtggtgtccggctatacaggaggtcatactgagaatccgacttacgaagaagtgtgcagtgaaacgaccggacacagagaagccgttcaaatcacatttcaacctgacatttatccgtatgaaaagcttgtcgagctgttttggcagcagatcgacccgactgatgcaggcggccagtttgcagaccgcggaagttcatatcgggcggcgatatattaccataatgatgaacaaaaacaaatcgctgaagcctcaaaaaaacagcttgcagaaagcggcatatttaaaaagccgatcgtcacagacattttaaaggctgagcctttttatgaagcggaaggctatcatcagcacttttataagaaaaatcctgatcactacgggcgctaccgtgtaggttccggacgtcaaggctttctggatgagcattggagggacagataagatggcttttaataaagaagaaaaaatcaaatcattaaaccgcatgcaatatgaagtcacgcaaaacaacggaacggagccgccgtttcaaaatgaattctgggatcacaaagaagaggggctgtatgttgatatcgtatcaggaaagcccttgtttacatctctggataaattcgattctcattgcggctggcccagttttacaaaaccgattgaggaagaagaggttgacgaaaaactggacacaagccacgggatgatccggacggaagtgagaagcaaaacagcggactcccacttaggccacgtatttaatgacggcccggggccaagcggtctccgttattgcattaactctgcggcactccggtttattccgaaagacaagctgaaggaagagggctatgaagcctgcctgcatttatttgaaaaatagagctcagcaatgaggcctgcctatcagacaggccttttttctatgtttttttttcttcatgtaatcgttcaataatctttacgattgtttcttttgtgatgagcggcgcctgatccgattgatatctggggagattgaccttccgaaattccggatgtttggcgggatccggcaatatcgcgtaaagattgccccattcatataaagattccgtctcatgaggagaggtcagttcttcatgaagcttctcaccggggcgttttcccacttcaacagcggctggctgcggcagtccgtgccggaacgcatattcttcaaacccgtgaagcagttcttcaagcctcagggactccattttaaaaataaacgtttctccgccctttgtaatcgccgcagattgcagggtgagcgttgcggcgtcatcgatcgacataaaaaacctcgtcatgtttttatccgtaatggtgagcggaccgcctgccatcaactgctcaaataaaataggaataacggaaccgcgtgaaccgagcacattgccgaagcggaccgaacaaaacaccgtaccgcggttttgaacatgatgattcgcctgatgaaacagcttctcggacaacagcttcgtagctcccattgtgtttaccggggaaacggctttatcggttttttaagacatttactgcattttgaggaactatcagtggcggtgagatcgaaagcgtaaaattaaacttcaggataggggtgatttcaaactgagccggaattggcccttttctttttgtgtcatcgtaacgataacttctttgaagaccattcttaatagcgagttctttttttctgtgcttgtttcaatgtgatattgatcaattatcttatttatgttgtttctgactgtattactgtctatttctgattgcgcttcttgagttccattgagttcatgcttggcaatctggagttctttaaattcttcatctaaaacagcttttcttttcaaaaaaagttcatcagtgtaaatgccgctttcatatttctcgaagataaaattctctttgttttttaactcttgttctttttgtgaaagatgttcagacatttgcttctttgttttcacattactatttacgtcttcgtatttagaaatcatataaatgatatgttttgttaaagtcttattatctaagttgcttaaagaagagaggtaatccagaatggcattttcaacatcgttatatctcacataagtgcatttattctttttgcaagtgagtgatttaacgtgatacacactttccgtgccgtttttgttttctcgcgttcgcctagtttcgtatttagataatggttcaccgcacttagaacaagtgcatacgcctgccaattcacttaattccaatgcgtttttattaggcagcaggggaactttgtttgcaattttctcttgtgattgttgaaattgttcttgatctattatagggacgtgtgcatccgatactataatttgttccttttcaggtctaattgttcgtttaccgtcttttgttttttccctaaccttatatttaacagttccgatatacgcttcgttttgcagaattgctttaattgtgtattgattccagcgcttttttcctgatggagtcggtatttgtaattttgttaagtgagaagcaatcgctgtataactaacttcttttccattcaacccatttaaaaagatgttaaagatgaattgaacgacttttgctttttcttcgactgggactagtttggatgtttttttgtttaaccggtatccataaggcgctagtcctgaaatccatttcccttgtgccgcatatgtgtatttagcgcctgtcatacgctctctggtcatttcaaattcttctctggccataaacaattcaaaacgaatctgacgcatgtctgcaggatttcgagggtcataaactttatatggtgtaatgataatcaatcgcttactttgaagaaggttaacaatttgtcccgcatcactgtagctcccgcggctgagtcttgttatttctttaacagcaattgcctggtacttgccttcctcgaggtctttaagacattctttaaaaacagggcgaccctcaatgctttctccagatccgatttccatttttaattcataggggatttcaatcgacttcagtattttattcatgagttcattttgttctgttagcgtatcttcgcctgttcttttttcccgctccatatcctgacgagagcgtctgagataacccaaaatatttgtaatgttgtaagaatgaacgatgttttttaactccaaaaaaacagcacctcctctttattgtatttactgtaaaaacagaagtattcgtacaatattctgtctgacattgaatacgagaataacctaaattctgaagatgaaacttttctcgtccagttgtcaggtgcattttgtaattatgaaaatgataaagcgaaagaaatgaataaacaactattcattaaccgatacggtgaagagcttggaattagctccattaaaggagataatcgatcagaatatgaagaaattattcgtacttatgaaaagaataattacaagcagaaagaaattaatatagatgagctgctgcaggcattatttgagacagagatgatgttatctttaaaagaaaagttttgataaaatcctaattgatgtatcataggggtttaatcagccactataggccacagagtccctcacacgctctgtggttttttgtttagattgaatgtaccaaataaaaaagaagcctcagaggacttcaaactggctctacggataggatagtaattaaaacagcaaataacacttacattttgttcaccacaagtgctgcttcaattatgaataaaattgttactgattaacaaattcgtatcctcagtaattattctgaggagtatgggggtgtttttattgactaactttgtccataagactatcaatggtttgaaaagtcttttagatgaaaaaggggctattaaattgttttgttctgagggatatattgtagagagccttgtgactttttctccaaacaaagcgtctcttagtgaaatccaaaactttcagtcgaatcataaattcactcttcctgatgattacctgaagtttatttctcagcataatggtgcgaaaattttcgaaattctttcagagggcgagaatattggaggaggtcttcatctatttagccttgaagaaatagaagaagaactaaaatacgagcttttgtttgaaggtatcaatggaatacctgtggctacctgttggaagaatgtcatttaatgatcgacaaggatagagtgaatcaaggtgatcctaattatctatttatatttgaaagtggttcagaatataatccattaaatttaaactttgaaatatttttagaccgatatattatgtcgaacggggatgctttttgggactggaaatactatacagctgaaaattattacaggacgagataaaactgtgtatgacagtcggaacggactgtctttttctgttaatcaaataataaagctatggtaaaatttagacagaaagaagcagaaaggagacgtaaatgaaagtatttgaagcatcctcgttaatttcagtagcggagaaacgggcaaaagaatacgatcagattagagaacaatttatcaatctcagaaaagcgtttcagggaatggctgatttagatgacaatgagttttcgggcaaaggtgctgataacatcaaggcattctttcaagatcacgcaggtgttacagacagctggcttgatctgatcgatatgaagattgcttttcttaacagtatttctggaaaagtatctgatgccggattgaccgattcgtttgtggaagagtcatttttagaacatgaactgattaatgcgaagaataaatcaaaagctatcatgcaggagcagcggaatgaaatgagggatattcttaatgagataagcgatattgttcatcttgatgttttctcgacagaggatgtcgatcaaaagctggattcagcagataagaaacgggacaataccgtacacaagctcggaaagctcgatcatgatctaacgaaggaatacgcagaaaccgaagcgaacgagaatttcatccaagcagactttcaacagctccaaaatgccacgggtaaagggaaaaacgcaacaccacttcactataacgtcaaggcgtacagagaaagtgtcatacataagaaaaaaggcgagattgcaagacattcagatgcttatttgacgattaaaaaagaagaagcgaaagagcgagaaatcaaggatctgaagaaaaagctctctgatggagtaactgatcctgatgaatacttggagattgccaagaagatcggttacgagaaccttgaaccttcccaacaacaatatgtgatgcagcttgaacaagcaaaacagatggaagaagccggagaagtgacctgggatattttaaaaggagccggcgtcggcctttatgatgtcgggaaagacacggtaaccggtttgtggcagctgatcagcaagcctgatgaagttgttgaaggtatcataggggcagttgcccatccaattaacacgtataatgccatttcaacagctattgaggaatcgtatcaaaaagatatggtgaacggggatgcttactccagatcaagatgggtgacatatgcggtcggttcagtggctgtggctgtcgtcggaacaaaaggcgcaggagccgttaacaaagctgatgcggcggggaaggtcataaacaaggcaggacaggcaggtcagaaaattaaggacattaagatttcagatttgcttccttataacactaagtatgatcttgctctggctgataacgtaccatacaatgtggttaacagccaaaaccttaaaaatggacttttgtccagtgcaaagaaattggatgaaagcagaaagccatttactggtcagaaagtaaatgtcccttggttaaataaagagaagtatgaggcctatgaaatagacggcaaggtaaaagttaaaggagagcctagagatgtaagccgtagagtatacacaatgaaagatattgaccttaatcaaaaaaatcgtaaaggctttacgaatcttcaactgatgaaaaatggtaatgctccgtttgctaaagatggcacgcaaataaatttacatcacttaattcaagaagagcctggtactatgctggagatacctgaaagctggcataataagtacagtgatgttttgcatggattaaaagggaatggacagagttttagaaatgatcctgtgcttgataaacaatataaaagtttcagaagaaggtattggagatggagagctcagcaatttgagaatcaagaataagaggtgaaagtttaatggattattcgaaaataaaaactttctttgatgaaaataaagaaaattcaattctcacggggggagtcactgaagatcagattagagaaatagaagaggagctcaatgtaactcttccagacagctataaatggtttttaactgagtatggttcagggggagcatacggaacaatgattctcggatatgactctcacggcgctgaagttgtcgagcagaccaatgaatataaaaaatattataacctttccgatggtcttgtagtgatcgaatatgtagatgaattttcttattgtcttgacactaacaagatgatagatggagaatgcccagtcattctttgggataaccaagagggatatggtaaacaagttgctaggacattccaagagtttttaatagaagagcttgaagaatcgaaagacgactggatcgatgatgaggactgggacgattaaaactaaaaagaaggtctatatctgtttttccatagcatatgaaggagtattaaaatgagcttcactaagatcaaacaaaagttgaaagagtttacgattaatgctggcacagatcctagcattaatacaaacgagcagctcaaagaaattgaaagaaatataggtaatcaattgccttccgactataaggattttttgaagggatatggaggctgttatttagaaagtaaaaaaacaacagatgaggttgagtatgacgtttgctacaaacctatagagaaagatccttggatgggtcaggaagatgatacacaattaatagagagcttctatggtttagctaacgatcataacagtctccaagaagcaatcaatacttattctgatcgctttcccaggaacattattcctatagcaagctcggcaggtgggaatgaaatatgcatggatatcgataatgaaaagatattgttttgggatcatgaattaagtcaccccgataaagactttttccttattgccaactcttttgaagagtttattctaagtttagtagatgaaccaattgaaactgataataatgacagtgatgtggaaattgaggttttagacaatgactttgcaaaattgctctttggtaaggacaattagcttttattgttaggaaaagtattgcaaagttaagctctcagaaagagagcttttttattttcgatagaaactaattataaaaagggagagaggttatggattcgtaccaagtaaagaaattaaaacccgaagaataccataagtgtaataatatttgggacatggaaaagaaaaagaaaatggctaaggtgttttatgacgaattagtaagcggaaacagaattacttttatttactcagtgaatgacgagtttataggagaaggatcgttagtttttcaaaacaatgacccagattataccattccggataaacgcatttatctgtctcgtatgattgttaaagaaggatattgaaattgcgggataggcggtattattgttgattatttgattgattatgctaaacaacttggatttgaggaaataacattcggtgtagatacagataacttaaacgcaagacatctatatgaaaagaagggctttacaaccgtattatttcttggtgaagatgaatatgtaaaactccttaaagtattaaaataaaattcccgagaattatggtgaatgtgtgggaggttactttcacaaacgatgatagacggtaacttaagctaatctaattcgttattaagatacggattagcatttatcctctcaaaaccaacccgtaatgaactaggatactgttggctgaggaattatttttccatgtattgtattttatggtattcttgaaatgaaaggaggagacaatgaaaaagaaattaattggggtcttgatcattgtttgtttttctgtgttcatgtatggcgcagttacacattcttttaaaaatcaaaaatccactgaggaagtattagaaagtgcatgggatgaatttggcttatttagccttggaattggagaaacagacccagtcatatcaattggtatggataaaacaaaaaatgaagaagaattacgacgctatctaaacgataacttatctaaggaagttaaagaagaatataaagttgagatcattaaaaaggatattaaggttttagaaagacaacatgagaagtatttggaaagtaataaagcgcattgatacattaaagatgcttatcggctccaaatacaataatgattttatccaataaacaaaagttttgcaaaccattccaatggtttcatttaatctgttataatcaatctgtaaaatacagactggttatagtgtatttctttaacaagaaatgcataaaataaaaagagcatggtgttggtcgcaacccatcaaagggcttgctcagatgttatgttattcatgatagacctaacccttcaggttatcaggctcaagggaggtctattttttatttatatacgtcaacagggcgattataaacgacccaaatgcaagcattcacattaatgcctgaaatgttgacataagcatcaccccctttctatagggggtgagcaagactccaagactccaagattcccttaagtgagcatacttaatgtacaggaatcatttatatgtcgttaaaaacccattcagttacctatgcgaaaagaaccatgttagaatcaggttcttttttgaatttgagttaaataatcggctggaattaccgataaataacatgtgaaataataccaaggaggttaagggattgaaaaaagtacttagtttagtaacaattacacttcttgctgttacaacgatgttttccattagcacatcgaaagcaaaagcaattgaagcaacaccgctttacagtcttcagattctttccgtcacatcggatggaaacgactttgtatgggagcctgttacaagcagcaagccaaatgcaacaaatgttttgaaaggtgacaagctgcatattaaagttcgctttatgggctatacaaattcgaccgtcattaaagcaaaggatgggagaaatttgttatacaaaggtgaagcgaacatatacaaatatgaccctatacttggacaaaacaaagttgtgataggatgggacaaatacattgaaattccaatgaacgaacttccttcaaatgagattcaagttgaaggtcttgggaaaaacatgaaaatcatttatagcaacgttgtaaaattcgagagaggatgaatgttatggaaggtctaaataactcttacaatatcacgaaagatccgaaatttttagcgttttgcagtttagcgacagaaggtgcaggaattagttcgaatacgcaatgttcaattggttttaatgaattcaaagaagcgctggagaatggcaaagtagttgataataaaaaccttaaaagcagttcagagttaaatcaccagtttgattactggaagtccagaataactgggggacgagctgtaactgaaactgataatcaagtgttagatatcatcaaacaagcatacaatcttggaatggttacgaaagataatatgcttttgagaaatcaagccattaacgcgtataaaacatctatttaatttaaaattaaagccccttattcaggaaggggcttttgctttgcaacttattctttatgtttaatctaaaaccataaagtcctgcacttttgtttcttcttcaggcaaatcaaattcattaagtttctttttagtacggatatcaaaaatccccatatagccaccaatcccttttttgttttcctcttgtgaaattacataaagtttttgatctttaaactttgcattcatatacggaaattttaaatcgaatttttcaaaagaaaaatctttatcgtactcaagtaagcaggcgtatacggatttattaatatatgtaacgtaaaatttaccgctttttttgtcgtaatacacagcgtccgcttgttcgagatcatcaggatattttatgaattttgatttccatgatcctttttcgattacagttagttcatgttctgagctagctacaacatatttttcagagtgatcaaatacatctccataggaagctaatccaatcgttttaataatcccttctgtgtttctatcaatgacgtacatagacattccttgaatgacgtaaatatacctattatcgcttcctcccatggttacgagggtaggcaaagtcaggctatattttttattgaactttttatcatttactttcagttcatttccattggtgtcgacattataggcttttacagaaatatcttctccttgataccaaaaagcaaatggattggataatttatgttctttaatagtgttgttttttaatgtgtaataatatggttcatgttcagctaacaagacgatatcgtctgaagagggggtttttttctggatatatggtatatccggtaccttaaagtatcgtttattgaatttttctccttgtgatgtggatatgagtacgcttttcttgatgagtggatttgaatagataaaaaagattttatcctcggttggatttattttagaagtacttacagagtgttcacctttatttataaagaatgcattgatcaacaatataactattgcaccaattagaactcctgaaatcccatataaaacataagactttttcatataacgctccatatcttttatataaaaaaacacacttgcagaataaatctgcaaagtaaatgattaggagcagacagtttttgatgagcggtcaatatccagatgtgacaagtgcttctccattactgtttaggtctgttccttttgtgtttttgtatgattgccacacaagtttagaggagcaatactatttatttgtgctttttttggttgcagctatgaataaggcttacctgttttactatgaaggacagcattgcatagagctttacaggtgaacacagatcataaaaaaacaccccctatgcgggagtgccaaaacatttatgcggtttgccctctacgttccactgagaagtcattatggtgatcaagcgcgatatggatactggctgtgtggcctcttcgggcttctttaaaaactttgtggccgtcaagaagataatgtccaacaagcccaagtaagataactaaaaagataaaagccgatgcaaatttaaatttcataaagacaatcccctctctgaatttgttttcgggcataaagcactttctcataaaaggctgtagctactttatggtcttcatttacattataatacattgctgcatcagtcgctaggtcttccacatccgaaagcatagcttttgattctaagtaatctaagattttaaaaagtcgttctttgtcattctcaacgaataaacccataagaaaatcaaacatttttcctaatacgtcatcgttcaactcctttgaaagcataagaccttgttcacaaacctgttttccatcgaccgtgttgaataatttaaagtgcgtttttgccaacattagaagtatgtcaagcagtcggctagaattgtgaagagaattactttgataaattgagacgccttctttaaaatactccaatgccttctccatatgtcctgttgtaaatgagcataaaccgagattgtacaaagaagaacctattaaccgcggcatatcaatttcttgtgcttgttttaatgcattcatgaaatgcggtattgctttttctggatactccatgtctaaataattcagaccgatgacgaatgaacattggattactcttattgagtatgtctcgtgtgctttgtaggtttctattgcttgaacaatatgatgcatagacatgtgggtttgcttcatgtgatagtacacttcagcaactttgtagtgaaattcagctcgctctatttcatcggggacaatagatatcttcttttcagctcggttgtaaaaacttattgctttaagatattcgtactgttcaaattcatacatcccatgaaaaaagttaaaataatattcaagaattccttttagatcgctttgtttactttcgatctcttctgataagtctgaaattttaggtcgttcttcattcatggtttttggttcaagataatcaagcattaattgatgtcgaaaacacatgagcgaatagtacaacaataaatcttgatcttcttccatatgctctatttcttgttcaacttcaccctttagaatttctgcatctgcaacactgaataatcttatgtatttgtaccatttattgatttttaagccaacctttgaagaagagatcaattgctccaaaaaaatcaccctcctagtatttcgactgattatgtaatattttatcataatgtaatatattaggaagagtgttttttcttaatttctcaatttggtgtggaatgcgatagaagccccctcgttcgagaaggggatatgatcaatttcctgttgctttcagtgaggcaagccactcatctaatgttccggagaagccttgttgaacggctaattcatatgctgattttccatctttaccggcagcgctagtagcttcagtactgcctttttcaccttttttttaatgaagctaaccattcaaaagtgatgaatattcaaggcgggagtaaggaaaattaacaaaaaatgtgagggaatttagatgaaacgatttattttggttatacctttattggctgctgttattgtctctccaactcaaatgaaagcaagtccaatgccttgtagtgcagtactcgaaccggtgaatcaaaaattgaaaaatgcgaagggtgcggcactaatctataaagtgcagttatacccgccaagtgctgcgagaacgaatatgagtattcttgctgtccaccttcctcagccatcttcttatggaagctacgacggttatgaaggatttgcctccaaaacaggggagatcagttggcgatttaaactatatccgactcccgagggagagagtcctaattgggctggaaggattgattccatatcagctgaagtgacaaatgttcaagtgcaagtacgcctttcaaattctaagacgcaaaagttggggccgagtgtattaacaaataatattcaatcttgctattagaaatgtagagctcttatcaaagaaagaaatgcgactggatcttttgaaaaaattctggtgaaaaatgaagaagagtccattaaggcggagtccaatgaatgatgaggaattaagaatcattctgaaatcaattcatcattgacagaacagagccggcaaaagtcgatattgcgtttgattttgtacaagaaagacggcataaaaagaaatggttagctaaaaaaaggcaaagagtcaacgctctttaccatcaggtgttttccttaagcggtctgcaatatgcttaattaaactcagcgcagcagtcactaatccaataactaaagcaatctcaagtaagaggataattccaaaatttaaaccgagactttcaaagtaatcaccagtaaaagagagcaattgataaatcccaagcatcagcacaataaaggaagcgcctataatcgccagagactttttagagaactccttagtatggttaaaattataaaccaataagaacaaaaatagacaagccatggcgatcttatgagtcaatgaatcacttgctgaaaacccttgcacaagtaaggagataattaatccggtcattccgattattttgttcaatatatcacctgctttgtataagtatgacttagatgtcagcttaccaattaaaggtgaaattctcaacataatgcagtttaaagttaacttaaaatgtgattattttaagaaagaggttgaaatatactcgattgtcaaaaaggggagcaagtaaggtctttgagaatggagaaatgggaattatattgtggacgacaaatcgaggttctgtaggtgttgaatgggactctggtgaatatggtgaatacaatgataaagtcgatgagctatttgttagcagattaatatgttttccgaaagttagacgaaagcagttcattaaaggaagggttagacaatgattaaaataacgctattccaagatgaatattgcaatggtgaatgggttgaaattgataggctattaaatatatttataagaacagagtcaattaatattgaagttattgatatcaaatacaattcactaaatactgtgcgaactcaaatacactctgcgtatatatagagaaaggacttaagatcactaggaccgaagatgaaatcgtgattttaaacgtagtaagaggaagaaatgaaaacctatgtagcaaccaaggaaactgagtactttaccaatgaatccattgaagaggtgctttatgctggtacaataaagaagctgcgtttagcaaaattgatggcacttcaggcaatagactaattttagatgtttgttttgatggcttgaggattaaatcttttatcaaaattcataatggtgttggcgagtagcttttgataaattggccagcgcaaagaaagaggttgaagactacaatgccaaactaattgaggcaggcacaatctctttgaaatgttggagagagctggacaagtctagataaaagatagtttttattcaaatactcaaggcagagcctatcgcacctacaatgccaacaaaatcaactagtgttgttacgttgctcataaagtcaaaagaattgtttattagaaacataaaatcagcccctgtgaaaaaatttaacactaagataaaaaataataagaagaaggattttatcactggcttgttttttgtgtaggagcagccttgaatattcgattgtattactaatatatcaaaatttctacaattaatccaattctctcttacgatagtttttaacgaatacaaaaaagccccacgaatggagctgctagattacgtattattgaacatagccagaaaagtcgctcggagcagagaaagatagatagtaaagcgcattggcatctagattttttattgttcctgtagctgtaccgttagcatttacagttagtgtttcagtagcaaaaatccagtcggaatcattccaaactttcacagttagtttagttccaatattatttgtaattgaatagcttatcgaagatttgccttgaaaataactgtttgaatataacgtattgccagttgcttgtccagcgaatgtcaatttgtttttcgtaagatttacaacgctatttgaattaggagggttaagaccaaaagctttaaattcactttcgacagagttagtaagcttagttgaaaacctagaattgtcggtctcagcagatgcggcagtggcaatgctcagagaaagaatggccaccatggtgcaaacaataaaactaaacaactttttcaaattaaacactcctttatttgtaagttaaagtaaataataacatttaatttcaggaggtcaatgggtttattcaaactggaatgaatctgtcacaaaatatgaagagcattttggtgaattacagctaaacgatttggataacttattgtattatgtactgaattttcagtctgttttgctaagcattaaggagttatgtaatagagagattatactctccaagattcaaaggaaggtatgcggagtttaccatgtagtcttaaatctataatcactttcagccagctataagaatgtttattaatcccatatggagagttagctttattaatacgacgattccttcaagatgcttttcattggcagattaaagtaagctaatccgtttccctgcagaccttcaataacaaatacattgttatggtcaaggttaatgtctaaaagcatgcttttccgttcagtgagcgggttattagcaattgaatgccaattaatataaattatatcgactacacagtaaacgatattataggcagattttttagacataaagcgtcccattacagtctcaaagtcaggaagcaaaaacaacagtaccattgagcatatcaagattcgagatttctcaacttgcttgttactttattgttgtaaacgagtataaagctggaaggttcagtgtagctttaggagccgaattgcttagagaaagcactgtatgaagagggattttaattaaataaagcagacattaagcctgctttatctttttgaacattattccttttttatatgaattaatgttctcaccaaatgcccgtccttaagattttaaattctgggcacggtcagactttttagggaaaatacattctaacaaaagaaaaaataaagttaatcctaatgataatttaaaattgtcgctgttcccaatggaacataagatacccactatataaataaataaaaacctaaacaacgaggcaaatataaacttgaagaagttatccccaatgagatgccttccaacagccacaaaaatattatcaaaagtaaaagaataaacaaccatacacacacttgttataacaatctgtttaaattctatttctaattcaaagaattttacaagcacatttgctgatcctgttgcaaataagattatcaccattatgattgcagtaggaatgagtgataaaaccaaagctcctattactgtagataataaaaatttttcatttgtgtttttttctgcagcttctttcttttctcctctgtacataaaaataaaaaagacgatgagagataaaagataaattgataacgtcataacaagcagattcatggtaatctctccttacctaattaaaacaaaagagtgaaggttgtaagcctcactctcttgtttttaatgtatagttataccaaaaagaacacaacaaccttcgcaattaactgtgcatcagctaatggaattccggctttcactaaggccacagtaacagctgtttctccgaaatttgtaagttcatctataacgtccgccgctttgtgtccccacttagaacaagcatcaccagctttttgtgcccatttatatgggatctttttaataaggtttcctaaagcggggccaccaaccctaagtgcttttactaatatttgtttagcgaaaggaatgccctgtgtatgtacttcaggatttgaagctaaaggagcctgtacgctattttgaactacaggtgcttttttactttctgctgcacttgcatagccaggagaaacaactgatatagccagcacagccaacgtgaacaccatgataaatgaaataagttttttcttcatttcttcaccatccttaaataaccattagtttaatatatttacaaatataatggatatttgtaatgaaatcaatatattacctaaaaaattttagttataaaagaaggaacaagaattttaaaaacatacttttgttattatacgagacacaattttcttaaaaaagaaccgaaagtctcattggggatgcccattttatgccgtggagaagattcaataaaactgtaggtttaacaaaaacaaatattttcaggagtgtaatatcataaaacactcagaggggaattaggtttaagaaacaccattggcaagattgaaattgttggaattttactggagtggtttgctttatgattttggggcaggagttaaggcgaaaagagataactcagacttggaatgatactgaaagcaacgtctacgatcaactttgacaaatactcaactgctgctgtcgttcaaacattaggatttgcttttaatttgcctacaggggctggtcatctgatttagctggattagctaataatgatcattctaggtgaatataaaattgtttacttttaggataagcaggaatgtaagatggcagggacggctcttatgacaaaacaccttgtaacgatttatgaagataaggatcaaaagaaaaaatcgggagtgacagctttatcatcacagacaaaggcggcccaaaagttgctgcaatgtgataaaaaataaccctgtcttaggcggggattattacatgctgtttattatgctgtaaacaaacgcaacaataaataatggataagagataatagcaattagttttgaagatttgctctttttttcaaatgtgtatattagtgcaaatcctaaaaagaatattgtgacaaaccaagaagaataggacgggtacaatgcaataagtaagacaataagagtggataacgcaaaagaagagtcaagtgttattttctgatcgtttttcaaataaaccgcctccttacacatattccacattagatcgcttaaagaaggtgttgtggttgatcagccaattaaatatttcatgatgcaattgtgcggttctatgatggtaaagacctcgccgtgttccataagactacggggaagttgttaaaatccttaaaaatgagtcgttttagtctgtcatttcctaaaacagtgttttactcttgttacaaatatgcaagaagggcggtttgaacttgtatagattatgtacaatgctgttaattttgttaagtataacattagggtgtcaaaacccaaagcaaacattttatggaggctgagcaaaccatggtcggctatgtcattttaaaaggagagaatcaagcaattttcatacataatgaaaaagctaatgttaaagactatgaaaatcttagtgaaaaagagattattaaaaagtatagatcggatatagttttactgggacttagtcaacttaacaataaagatgacttgagcaaaggacaaaaaattcgtatttggtataaaagattcaatgaatcttcaccgccaaaaacaaatatctcaaagtttgaaagtatttagtatttattctttgattcccagaaaaccgctgcaaaactgaagcggcatattgaaccgaaataatgtcttcaaacctcacgtcattcttcattcgcggtggcttattcctgccccaggatttatttgacaattgttgactcaggtgcagagaaggcatatgtcaagaacacattttgaattactgggcaccttgaataaagccagcattcccatattcatatgcgaagagatcggtactgaacgctggatcatacatttgaacaagcttgcgaggctttgataaagaaagaacagtcaagagacgaaccattacatacatataatactcctgtgaaagcgggggtgtagttttggaaccttaccaacgttatgaggaattaaagaaaaaaacaataaaggttgtccataaagataattacagtatccgctatatagatcaggatgaagcgagtaatgacttagatgaattttataaacaatttgctcagcatttattggaggctgctttggaaaggagtgcagagtaagcttctttttttgatttgtttgtggtaagtatcttaataaacggctttatcagtactgatattaatcacatgcgtcacttcttgcagcaaagccgcttctgcgacattttgtccgccgataaggttggtttgaatggcttcaaagggattatcctcacatgtcggaacctgcttcagcgcagctgtgtgaaagacaatatcaacacctttcatcacttggttgactcttctgtagtcacgaacatcgccgagcacaaacgacagtctttgttcatccgcgtatttttgcttcatcacatattgtttactgtcatctttgctgaacacaatgacttctttaggggttaagagcaaaaggcgttttactatttggcttccgattgatcctgttccgcctgtgacgagaacagttttatcgtgaaaaaacggttgtagctctactgcttgctgtttaggcatggcttatcctccaactctcgtttctctaccatgcatcatatgttgaacaatttcagcgagttaatgaaagaaaccaataaatcaaaaattagagaaaaacattaatctgatgcgctttcatatcgcgttacccgattaatagaatagaaattacaaataaaacattgtactaaatattcattttaaatatttgctcacgtcaattttttctcttcataaatcctcacattcggacaatcttcacaaaaacttaacactgaacttcctgtatgtattttacaattaaagtgcacgttcataaaaggaggatggaaaatgaatcattcaaaaacacttttgttaaccgcggcagccggattgatgctcacatgcggtgcggtttcttcccaggccaaacataagctgtctgatccttatcattttaccgtgaatgcggcggcggaaacggagccggttgatacagccggtgatgcagctgatgatcctgcgatttggctggaccccaagaatcctcagaacagcaaattgatcacaaccaataaaaaatcaggcttagtcgtgtacagcctagagggaaagatgcttcattcctatcataccgggaagctgaacaatgttgatatccgttatgattttccgttgaacggaaaaaaagtcgatattgcggcggcatccaatcggtctgaaggaaagaataccattgagatttacgccattgacgggaaaaacggcacattacaaagcattacggatccaaaccgcccgattgcatcagcaattgatgaagtatacggtttcagcttgtaccacagtcaaaaaacaggaaaatattacgcgatggtgacagggaaagaaggcgaatttgaacaatacgaattaaatgcggataaaaatggatacatatccggcaaaaaggtaagggcgtttaaaatgaattctcagacagaagggatggcagcagacgatgaatacggcagtctttatatcgcagaagaagatgaggccatctggaagttcagcgctgagccggacggcggcagtaacggaacggttatcgatcgtgccgatggcaggcatttaacccctgatattgaaggactgacgatttactacgctgctgacgggaaaggttatctgcttgcctcaagccagggtaacagcagctacgcgatttatgaaagacagggacagaacaaatatgttgcggactttcagataacagacgggcctgaaacagacggcacaagcgatacagacggaattgacgttctgggtttcgggctggggcctgagtatccgttcggcctttttgtcgcacaggacggagagaatatagatcacggccaaaaggccaatcaaaattttaaaatggtgccatgggaaagaatcgctgataaaatcggctttcatccgcaggtcaataaacaggttgacccgagaaaactgactgacagaagcggaaaataaacatgaaaaaagcagcttatccaagctgctttttgatgtgaagagcgtttcatgagaaagtcttggaacggatagccgtaagcacagccggcagccggtcatacgtgtacgccggtactgtctcttgataattaagcgccgcgatttgtttacgttcacccgggtttgtcatataaaaatggatcttatccgcaaaatccgcaaacccgctgtaagaaacaaatgttgaaaacgggggcgcgggagaaaggtctgtcagctgaaaggcctgacaagccgcaatgtctaagcttctcgtatttaaactggtattttcgatgccgcgtccgttctgattgagcgcaaaccgataagaacggtgagggtttaagaccacctctgcgctgttgtaatataatgcggcaagttcgggttcaatccattcatccattacgagcacattttgctgtctggcgatttttttaggcagatgtctgcgccatcccttcccgataatacgaagcgtatacggaagcttcgccgctgctttcaccagttcaacgcggttcggatacgggtatccgatcagaagcagatttgtgtgaagagaggcttcagcaggttgttttttaaaaagccgctgattaacggggatcgggacataatatacgtgctgtaagcccatttgccggtaagcatcaagcgcgttttgttctatcgttaaaacggcatccgcaagcggcgcgattgtcatactcacatcgaaataaaaaggatcctccgtcatccatagatatacgggaatctgttctgtcttcagccattgaagccattcagacggaatacggtctcccgtcatcatcagactgatgtctggtttgaatgcccgtatactgcggatggtatcttcctcaaactcagaaacagaaaaaaagcggacggaagactgtaaaaagccttcctcgatccagcggtcaaaatacgtgtatatgcctttatatcctgaacggatatataaaacgttcatatgctgttacgaagtgaacgtgacactttcaactttgtcgacgtcaagcaatgttgtagcagagcctgccggtgtaacggaattttcctgcgtaacaaaaacgattccgtgaatttcgtcaaaggcaacaaattgaaccgggccgatcatgtctcctgaatccatcacaatgctgatgacagtgccgggctgaattcttgcaaaaatccatctcgccgctaatgaaataccgcttcccaatacagattgtgcgctgagactgtctttcgccgctgcttcatccacttttgcatcaattgccgattccaataaatcttttactttgttttccacattatctcctccatctgtgccgccagataaagcgctgttgtcaaatacaggggctaaaagagtttttaataacttctttttaagctccaaacgatcctcgctcatgcggacatacacctcctttacaatttcaacctcacgtttattcatattcctgattgaaaagattggtataagtcgaatgccgttttgcttgcatttttttcaataattaatcaaacagctgaattttcgaatcaggctttgtttgcctatgcggattgtaagagtatgacatacgttgtatagattaaaaaatgaaggagaggaatattttggattcaggagaaactgtaaaacacgggggttttgaggaggaatttcagctcgtactgcttcttcttcttttgttatctcatcagccgtccggagatcattcagatttgcggcgtcagcttgtaatggcaaaagagcttggggttcctgtgtcgcgcgtcaatctgattaacggcagcacactgcagaacgtaattgtcaaagaagtgctgtcagatttggccgtttttcaaaatccgctcaataatacgagatcaaacgtcgcgatttcaagcatcgtcagctgggggctttttaataacgatatcaggctctgtctctttcggagccgttttttacgttttacagaaggggtgatgggatggaaaagaagatctcaattatcttaacgagttacaacaaaccggatcttgtaaaacaggcgattgaaagtgttttgcatcagacctacagcaattgggagctgtttgtgatggatgatcattcaaatgaagaaacctcggccgccatcagtacgtatataaaagatcatcgcatatattatgacaacagttttatcaatccggccgaacggctgaagtcgacccggtatgccgttttgattaatgatgcgctttcacgggccgaaggcgaatacatcacttatttgacagacgacaccgtatttcatccgaataggctcagccgcatggcggaagcgcttaatcaatgcagcgagtttgatgccgtctattccagccagaaggtgatacatgtaaacgggcgcggaacagaacaattccacttctatcgttttgctgaagaggtgcttgatcaggccgcttttctcgttgatcactgttcagtgatgcaccggagatcattgcttgagcgtgtgaaagagaagttcggcagcttttgggacgaagatgttatgcattggaatcacggagactctgttttttggagcaggctcaacacatttacatcatttctgccgataaaagaagtgttggatacgacctataaaacaccccactcatttcagaacacgtatcaatcgcttccgtctgtcctgatcgacggatcctttgtaaaggggacggatcagaaagtatatcagcttgaccgaaataaaaggaagcctgtaaacgagcgctggcatacgttatacgaaggccggaccgtcgtcattccggatccgtttttatttcaatatgaggaagaggactccgccagtattccgaattttcagctcgtcagggatcagtttcatgtttattttatagaagacggggagaaaaggctggttgatcatagcgcatttcgcttttaccgatttaaacggcatggcatcccggctttagaacgggccgaaatacaatcgcttccggacggtccgccgatcagccggtggacatcggactgtgttcaacatttgcccgggaggatgctgtttcgcattgaacggaaattttatgtttatttgagagggttctccatccgatcagtcatgacgtagcgaaacgattttttgcgaatcagaaggcgatacccatttcctttcagcaaattaaacaattaccaattggaatgccgttctatccggtgtacgatgaaattataagaaatctcaatataacaaaaggttgagagatgcagtcggatgtgcaaggaaaaggagagcttttatgaccgatcaatttgataaaaccgagaagcagtatatagagcttacttccggcattcagaggttcgagcatttcagtgtatatacggacccttttttgccgcagattttttcgcataactttgttcagctgcaccgtacatttccgttagacaaactgctgccgtttctttcgtccgttccgggcatgcttcaagccaattatattcatgtgaaagcgtctccggagcacgcatttccgcttcttctgaaacaaactttggtaaagcagggctgcgtagtggaagatgagctgttttttgcaaggaaactggaaaatggggacctgcaggccggacacccgctcactgcttgggggacggaaaagagcctcgccgatgggtcgtctattatgaacatctatgatgccctttacattggcgaggcggcggccgaacaaaagcttgagcggaaatatcctttgtataaggagggaacggttatgcttgtcgtgtgctacagcgacgcctcgcaaacgattccgatcggctgcggagagcttttcatcaacaaagcagataaaaccgcaaaaatagaagaagtcgcaattctggatcaattccaacgaaaaggctacggatcgatattgatgaatgagctgatggcggcggcaaagctgaacggcatggaaaccgtataccttgtgacgtccgggatggacggtgtaaaccgcttttatgaaaaactcggcttcaaaagatttcggcgcgtgcatacaatttttcattattttcttacatagttgggcattcgcataaaccaattgggagttggcccgcatacaatgccgtatatcgtaagaagaaaggatgatttgcgtatgtacggatacggatatggctacggttgcggcagttttggctatggttacgggcacggcggctgcggaggcggaaccagcacttttgtgctgatcgtggtattgtttattttattaatcatcgtcggtgcggcttttatttgttagactgaaaaaatcctataatgaaaatcagcctgcagagaacatcattttctgcaggctttttgttatttccatgctgaaaaatcagcttgaaaaacattttaatacatattacctttctggagaagggggagaaaatgtgaacatgacgattgaagaattaccagaatccagaattgcttatttccgaaacgtcggagagtatggcggaaagcaaaacaaagaactgatggagtcatttaaaaactgggcgcaattgaatggtctgcttgattattctgtcattttaggaattccgcaagatcatccgaatcgtactcctaaagagaaatgccgctatgatgtttgtcttgttatcaatcaagaccatgtgcctgaaccagcccggatcggtacattttccggagggaagtacgccgttttcttgcttgatcatacaaaagaggcagtcagcggattttggaacactgttttttctgagatcgaaaaaaataatttatcaatcagagaacagcctattatcgaaaggtatactttacaaaaggtgaatcatcatttgtgtgaaatattgattcccatacagtaaagaagacgggaattttccgccttctgcttatactgattcagatcaaaaatgatgggatgagcagataaatagcagaaccgaagaaagaataaaatcaacaataggaatagaatttccagaacgctcttcaggctgtcgggacatttccggcagcctgttttacagaaaggtattttctgcaaaaaactttctgaaggataagaatgcggttattcatctgttcatacaatgaagcaaatgggttttcgaggtggaaagatatggggagctatttaatcaaaccggagcttgacgcaaattatccgtcagtcagtcatggtaagggatcatatgtgtatgatcaggaggggaacaagtatcttgacggagcatcgggggcggtcacttgcaatatcggccacggcacggaggatattatacaagctttaaaagaacagcttgactccgtttcgtttgtgtatcgctcgcaattcaccagtactccggcggaagaactggctttatttctggccgatcatctgccgggcgggctgaattggtcattttttgtaaacagcggctcagaggcagtcgaaacagcgatgaaaatggccgttcaatattggcaggaaaaagggcaataccaaaaatccgtctttctatcaagatggggaagttaccacggcattactttgggagcgctttcattatcagggttctatgaacggagataccgcttcacccagctgcttgaacggtttccggccgtttcagcgcctaatatgtatcgttcagagctgcagggagaggaatttgtgaaagctgcggcggctgaactggaaacggctgttcagcggatcggttcctcatttatcgcgggatttgtcgcagagccgattgtcggagcagccggggcggccatcactccgccggcaggttattatgaagcgcttgaggttgtctgccgcaggcacggtattttgtttattgcggatgaagtcatgacggggctcgggagaacagggcggatgcttgcttctgagcattgggggattgcccctgatatcgcggtgctcggaaaagggttgggcgccggttacgctccgattgcggcagctgttgcgtctgatgacatcattgaaacgatcaagcggggctccggggtcattatgagcggacatacgtacagtgccaacccatactgtgcaagggcggcgcttgaagtgcttcgctatgtcaagaaacacgagctgcttcggcagtcagaggaaaaaggcgtaatgctgaagcggaaattagaagaaatcaaagaccgcagcggggtgatcggggatgtccgcggtaaaggcctcctgatcggggttgaattcgttaaggataaaacgacgaaggacgttttttcgaaaaaacaggccttcaccgaaaaaatcattaaagcggcaaaaaatcggggcctgcttatttacccagcaaagcccggtattgacagcggagaaggagacgccgtcatcatcgccccgccgttcacgatttcatatgcggagctggatgagctgtcagatctattttcccagtccgcagaagaagctgaaaaaatgatgaagaaggattgagctgatatgtctatttttcataaaaaaatcgatattcatgaagcaattgccgatgtcaaggacgaatctgtcatcatgttcggcggttttgggggagtgggttcacctccgtcattaatcgaagcgattttggaaagcggcgttaaagaattgaccgtcatctgcaatgatgccggatttccggaaataggtatcggtccgcttatcgttcataagcgggtaaaaaggctgatcgcttcccatatcggctcaaatcctgtcgcgggcagacaaatgactgacggagcgcttgaggtggaattttcgccgcaagggacgcttgctgaacggattcgcgcaggcggagcggggctaggcggtattttaactgatatcggcattgataacgcaaccgtttgtgaaaacaaagaaaccgtaacgattgacggaaagtcctatttagttgaaaaagcgctgacggctgatttcgcttttgtgtcggcacatattgctgatgaattcggaaatctgacgtttgacaaaacggcgcgcaacatgaaccctctgatggctgctgcggccgaaagaacatttgctgaggcggcagaaattgtgcctgccggcgaacttgacagcgagcatattgtaacgccgggcgttttcgtggagggtatcgtgcaaagtgaaggagtgaagtggagatgggcttgggaatagcggaaagagagagtatcgcgaggcgggccgccagtgaaattacctcaggtatgattgtcaacctggggatcggcattccttctttagtgccgaactttctgccggccggcatggaggtaatgctgcaggcggaaaacggcgtcctcgggatcggcggtagtccggagcgcggagaggaggatgagcttttatgcaatgcggccggatttcctgtcagtacagttaagggtgcttcctattttgattcagctctgtcttttgccatgatcagaaaagggctgatagatattaccattttaggcgcgctccaagtcagcaggacaggtgatctcgccaattggctcgtgccggggaaaaaggtgcccggaatgggcggggcgatggagcttgcccaaggcgcgaaaaaagtggttgtcgtcatgagccacaccgatcagaaaggccggccgaagctggtcgaaagctgttcattgccgcttacagcagcaggctgtgcagatctcatcattacagagaaagccgtcatcagcatagatgatggggcttttgttcttgaggaactgctgaatggcacgaccatagacgatgtcattcaaacaacggatgccgaaatcagattgggagaatgttttcttaaaagggggtctgtccatggatcaattagaaaagaaagtcactgagtgggcggaagaaaacacagcaaaagcggtaagcctgctgaaacggctgatcggggaaaaaagcacgttcggccatgaatttaacgcacaggcagtcgttttagaaaaactgagacagtttgacatggatattgatgtctgggagccgagtgtcaaacaattgaaagagcatccttattttgtatcggaacgcgaagacttccatgaaagcccgaatatcacagccgtaaagaaaggggccgggggcggaagatcactgatactgaacggacatattgatgttgtcccggaaggaaatcccgccgcatggacgtatgaaccgtttacagctgttgaaaaggacggcaaagtttacggacgcggttcaacggatatgaaaggcggcaatacagccctcttgtttgcgttagaagcgcttgaagcctgcgggattacgttaaaaggagatgttctgtttcaaagtgtcgtagatgaagagtgcggcggcgcgggaacactggcggctgttatgaagggctacaaggctgacggggcgcttattcccgaaccgactaatttaaagctgtttgttaagcagcaagggtccatgtggttccgcattacggtaagaggattgtccgcacacggcggcacccgctatgaaggggtgagcgccattgaaaaaagcctgcatgtcatcacagcccttaaagagcttgaacacgtccgtaacgcccgtatcaaagacccgctttatcgggacgttccgattccggttcccattaatatcggcaccgtccaagggggaacgtggccatcatcggtagctgaccgtgtggtgatagaaggcaggtgcggaatagcgccggatgaaacgcccgaagcagtaaaagaagagctggcaagctggctgaaagatttggagtaccgggatgaatggtttaaacaccaccccgcggaaatagaatggtttggggctcagtggcttccgaatgatctcccggatgagcatccgctgatttccgctctggaatcttcttttgagaaaatgaaaggggcaaaaccggttcgtgaagcgtccccgtggggaacggacggagggcttttgcagcacgcgggacagacgccggtcatcgtcttcggtccgggagaagtcaaggcggcgcatcaggcgaatgaatacattgaagtccgggcgttaatcgatgccgtcaaaatcatttctctttttatcatggaatggtgcggggtggcagatgggggtgacagcgctgataaaggaactgagggctgaaagcggagcggccgagattgatgcagaccgtttcaacgagcggatcagggtcattcgttatgacggacagcccgaggcgcttataccggccgttttggcagaagcaaaggaagagggagcccaaaaggtgattttctttgccaagcgcggcgatgagccggaatttgtcaagcatctttttattattgagggtgccatagacgggtattacaacgggcataaggctgttgtgatggtgcgctatttatcagaggaacggagacggtcagattcatatgtatcagaagattcggctgttgaccgtttatatgagacaccgcggcggggaatgactcagacagaaagcacgctgatgttcagaaaagcggacgaagatgatgcggaccgtttaacgcacttatataaacatgtttttcttacctatccgactcctgtttttaatcccctttatattaaaaaaacaatgaaagaaaacaccatctattatgccgcattcgatcaggatcgtctcattggggcggcaagcgcagatatcaatccggttttggggcacgcagaaatgaccgattgcgcggttctgtcagattacagggggaactccgtaacggcacacttgtttaaagcgttggagcaggaactcgctggccggggaatcattcatcttttttccttggcccgtgcagcgtcttacgggatgaacgccgttttgtatcatgcgggatacggctacagaggcaggcttgtgaacaactgccgcatttcagaagggctcgaaaatatgaatatatggtgcaaaactttacgtttggccattcataaggaggaattcgtttgacaaacaaatggtttcagccgaagcgtcactggaaggagattgaattgtggaaagatgtgccggaagaaaagtggaatgattggctgtggcagctcacccatactgtaagaaccgtcgatgacctgaaaaaagtcattcatttgaccgaagaggaagaagaaggcgtcaggatgtctgtaaaaaccattcccctgaacattacgccttattatgcttctttaatggatcccgataacccgagatgtccgatccgcatgcagtccgtgccgctgtcagaagaaatgcacaaaacgaaatatgaccttgaagatccgctgtttgaagatgaagattcaccggttcccggtcttacgcaccgctatcctgaccgcgttctttttctggtgacaaatcaatgctcgatgtattgccgatactgcaccagaaggcgtttttccggacagatcggaatgggggtgccgaaaaaacagctcgatgcggcaatcgcttacatccgggaaacgccggaaatccgtgactgcctgatttccggcggagacgggcttttaattaacgatcagattctggaatatattttgaaaaacctgcgtgacattccccaccttgaaattatcaggatcggaacgagagcgcccgtcgtatttccgcagcggataacggataacctttgtcagattttgaaaaaatatcatccggtctggctgaacactcattttaatacgagcatcgaactgacggaagaatcggttgcggcgtgtgaaaagctcgttaacgcaggtgttccggtcggtaaccaggctgttattttagcaggcattaacgattcggtgccgattatgaaaaaactcatgcatgatttagtgaaaatccgcgtgcgtccgtactatatttatcaatgtgatttgtcagagggaatcggccatttcagagcgcctgtgtcaaaaggattggaaatcattgaaggactgagaggccacacaacaggctttgccgtgccgacctttgtcgtcgacgccccgggcggaggcggtaaaatcgccctgcagccgaactacttgctctcccaaagtccggagaaagttgtgatcagaaacttcgaaggggtgattacatcttatcccgagccggaaaactatatcccgaatcaagctgacgactattttgaatctgtttttccgggaacaatggccaaacgcgagcctgtcggactgagcgccattttcgcggacaaagaggtttcgttcacaccggaaaatgtatcgaggatcgacaggaggaaaacgtttacatcaaaccctgatcatgaaacgctgaaagaccgcagggaaaagagagatgaattgaaagaaaagaaatttattgcacagcaaaagaaagagcaaaaagcaggatcggaagtcggaggtgagtcgccgtgaagccatgcgagtggtgcggcaatcagaaggcgtcagcttgtcaggcggctgtgtactgggagcttcctgacggtacgagagccatagaaattacagaaacacccgcattcgcctgctcctcctgcggcatgacgtatcaggaggaagcggtcatagcggaaatcgaaaatcagctttttttagtcgatgcaaaaaaattaccggaaacactcacatatcaagagctgatggggacagaacggatcttgaaacggaattattttgacttctcctagtcttcttttgttgtaatttcacacttgaattgtataatagtacaacaaaagacagtcatcaggaggggaaacccatgaaatccttttatcactatttgatgaaatacaggcatcccaaaccgcaggacgcaatcagccggtttgcgaatcaggcatacgaagatcacggctttccgaaaacgtcaagcgattatcacgagctcagttcttatttagaactgagcgccgactatttagaaacgatggcgacatttgatgaagcttgggaaaaatatgagaccgaggtgcatcacgcctgacgaaaaaccgcacattgtgcggtttttttctgttgaaatcaatcgcttatgaggtgccgtatgatcaaatcccgcaatgcctttcgttttgatcagcgcgtaaacaagtcttcctgatggcacggatcataaggcagcagaatgtatagctgcagagttcaccggatcagacctgctgccggcggggtcccgtgtaaggagcctcttttcacggagaaataatcaaacatttaaatgaagtgagaggaatcaaatgatctatggtgaggcactgacgtttggacggaaaagggaattttatgtgacaaggttgaagcggattgaagttgtggcttcattgaaagccgaaacgagtttggttcttcatgataaacaagccattgcagatatgcagccggaattggatctccatacatcttcgatgatgtgtttcacggcaaattttgaacatcacggcggtgatattgtcaacatgccttcgggccgggtatttatctttgtgtcatggagaaataaacaaaaactcattcaaaaacaggcgctttttgtctcgtcattgttactgctcattcgatcgagagcgcaatgccatcagacgcttctgttacggtaagtgaaaaaacgcacaagcatgttggggtttttgccattttgaacaggtgcagaaatagatatttcctgtggttttcatgcccatgcgaaattatggcggccggcatacgatagcgtatgacagtccgcggcaagggggagacagcatgaagccagataaaccgaaatttcaagtgggagacatcgtggtcgtcgtgatgtacggaaccgtcggcaccattacgaaggttcatcaaattgataaacattatctttatgaagtcaatcataatgaagtgctttattttgaatcgtccatccagctttataaagattatgagggcgtgatcgtcgatatggaaaaattagatattgaatatgaatttctgatcggcgacgtcgtatatgtaaaggactacggaaaggaattattccgagttatcggtcacagaactgaaatatggagatatttagaggatggctgggaggatattatttatgagctgactcggctgaaagacggagagtggcttgaaacggaggaagaggatctcacgctggttctgagaaaatatgaaatggatcagtttgtgcatcagctgctgtttgtccactatgttggggaagcatctcatgagatcggcgaggataccgtcgcgtctgctcttcttcagtttgaaggcgatgctgatgatcccgatgccctgcatgtgctggcggtatcgattgtagatgagctgcttgatatttataacgattataagattctttatcatttgttcggtgacgaagaatataaagatatgatgaattttgtgctggaaagcctgcgggagcatttcagctagccggcaaaaaaacggacggtgacatataaaaaccagggcagacagccggcaaagatgacaaacgacattcctttcagcactttttccaatacgatatcaaatccatctccgtccaataaagccatcattttcgtcattatcttttctccctccggggcttgtttttttaaaagtatatgagcggacaaaacgtttagaactttcgggtataatttgaacggttttttcataaaacataaaaaaggaggcggtgtttgcatgaaagaaatagatcttgtgattgacacagaagaaatagctgattatttttacagtcagcttgctatgcgcgggtacataccgagtgaagaggaaatcttcgaaatagccgacatcacctttgattatttattagaaaaatgtatgatagacgaagagcttgatgaagactgaaactgcggaaccgaagtgaaaaagcttcggttttttcaatcagctcgggagaatgaaacatggggggaaaacgttgtacaagccagcaagtcttttcgcattgtttattctgctcgcagcagcgatccggatagaagccgtccgggcttttgatgagcgtgtgatagaagcggctgtcaggatcaggtctgtctggctgaatgaattgatgttatggataacggagctcggcacgaccgcggtgcttttgccgcttcttcttttgacaggcgcagctctgtatatgtacaaaaaaacgccggatgttgtttttttgccgcttctctttctcattgaacggattgtaaacataaaaataaaagaattgattgaaagagccagacccgcttttgaaccgctcgtccatgaaacctcatacagttttccgagcggccactccatgaattcggcagtgatgtatcccgtcatcgcttactttttgatcaagcatgttccgtttttcacgaaaagaaagagggccctcaccgtctttaccggagttctcgtcattctgatcggattcagcagaatttatttgggcgcgcattttccgacggatgtccttgccggattcagtctcggactttgcctcgtttcgctttttgcgctctttgacgaaaagtatcatccgtttcgacaaaaatagagacaggaaaaatgagaaaaaacgctaatactattaagaaataagagggagggatcttgatgctgttatcgctgcccgtgtttaaaaaaaagacttgtgcctatgatgtgacgatttttcaaacaccccgctacggcgagaaaaagggatacagggtcgtctatcggacagagctggccgctgacaatcatcaagacgcactggaaagggcattttctgtttttaatgtgcctgatacggtcccaaacgactatcaagccagattcatagcgaccggagacgtcatactcatagacgaaggaagaaaaggaaagacctattacaggcttaaccctgcgggatggagtaaaattaaccggctgctcgtccagccgaggtaagacggagccggctgaagattcagccggcttccgtattgtctgggaaagacagtgttaaggcttccgtttagcggcggaatgctcttttccatgcgcttcatcagctgcaatgacgtctgaaacgggcacgtgattgttctttttctggccggtcacccggttgcgctgttttttgcccattatgttcactcctttttctttaggcttgtcatcccgcatattctgcccaagattgccctgatcaatgctgatgattgtctcttaccgttattcagtgtacaatgggtgggagtttgaataggcaggaggaaaaggaaatgagtgtacatataaacgcagaaaaaggccaaattgcggatacagtgcttttgccgggagatccgctccgagcgaaatttattgcggaaacgtatcttgaaaatgtggaatgctataatgaagtcagaggaatgtacggatttacgggtacatataacggcaaaaaagtatcagttcaaggcaccggcatgggtgttccgtctatctctatttatgtgaatgaactgattcaaagctatgatgttcaaaacttaatcagagtcggctcatgcggagccatccgtaatgacgtgaaagtgcgtgacgtgattttggctatgacgtcttcaacggattcacagatgaaccgtgtcgccttcggcagtgtagattatgctccttgcgcagacttcgaactgcttcataaagcgtaccaggaagcgcaaaaaaacaatcttcccgtagcggtcggaagcgtattcaccgccgatcagttttacaatgaagactcccaaatcgaaaagcttgccagatacggcgtcctcggcgtagagatggaaacgactgctttatatacgcttgccgctaaatacggcaaaaaagcgctgtctatcctgactgtaagcgatcacgtattaacgggagaagaaacaacggcagaagagcgtcaaacgacttttcatgatatgattaaactggcgctgcatactgtatcgtaaacttgagatgagggttatgctgattaaagcagccctcttctttatgcatcgccctgattcaaaaaaagaaaggtaagggtaaaatgaagaaatccactaaatggttctcgctcgctgccgctctcagcgtaaccgcaatcgtgggcaccggctgcagcatttcagacggcgacagccataaggacacaaaaacagcagctgaaacaaaacaatcagatgacacatcaagcaaaaaaacaacgaagacagaaaacagtgattttgtattagagagcaaatattttaatgatattaaagaagtgaacgggcttgagaccattcaaaacccgacaaatacacttgcgctcgtaaataagacatatacgctgccgggagattataaaccgaatgatctcgtaatcccgaaagtcgaattttcttttactgagaaaatcgagaaacgatatatccgcaaacctgccgccgatgctttggcggaactattcagcgccgggaaaaaagaaggttatgacctggttgccgtttcaggataccgttcttatgacagacagaaagttattttcgataatgaagtcagtctgaaaggtgaaaaaaaggcgaaagaagccgtcgcatatccggggcaaagcgaacaccagacggggcttgccatggacatttccagcaaaagcaacggatatgagctgaatgaggcgttcggaaacacggcggacggcaaatgggtgaaagaccatgcgtatgaatacggctttatcatccgctatcctaaaggcaaagaaaatgttacaaagtatgagtatgaaccatggcatttacgctatgtaggcaaaaaagcggcaaaagccatccatgaccatcaattaacgcttgaagaatattttaatgaagtaaagaaagtgtaatgagaagaagcccgcttgaaaaatagaaagcgggctttctttattaccagaagagcagacctccaagcgcaaatccggtaatgaaaccaaggccgataccgtaggctgctccccagcctccccagcctcctccccaataaccgaatccgtaccctctgtgacggccgccgacaggggtgatatacactttgctgttagtcacccgtacgattcttccgacgtggactctgccgtttcgttctgtaattcttgctacttttccttggtgctgccggcaaagatgataatagttttgcatcttttctcctcctatccaacctatctttctatgtcagcttatgatagagtgcggtaaaaaggttggacgaaaacaggaggacaattgccgttttacttgtaagcgacaaaagcgcagtgtcccatatattcacggtacgtctgcataagctcgtaatgagccgtcagcgtatcgtagtgaaccggctgaataacgggcgataaatccatttctgtagtcggctcctgcgcattgttttcatagacagcgggaatgaaatccgctttctgaaagccttgctgaagcaatctctgtttccatgcggtttcatcctgcaatacggtaaaaccgtagaagtcttttatctgcgtgatggcgttttccggcatgggcttttgtaaagcagcttcaatgccgatcagcatgcccccgggtttaaggacccgcaggatttcagacagcgatgaatcaagatttgaaaaggtgagaactgattcggaaagaacggcggaaaattgattttcagcaaacggcagccgctcaagctccgctaaatagcccggaatggttaagccttcagcggcaaatcgttttgctgctttttcaagcataaggggatccttatccacacaggtgacgggatacagcaggtggccgagataagcggccgtctgtcccgttccgcagccggcgtcaagaatcggttcgccaggaggaggagccgcttttgtgagaacggctttggaaaaagcgagcccgccggggtgagcccctccgactccgaataaggacagcatttctaaatatttgctcaaaggccgaatcctccttttttcctcagcatatgttgagagaaaagcataggtttgggtaaacgggaaagaagggcgcctcacgtttgaagttgacgaatgagcgttcgtctatgataataatgtaagaataaaaaggtggtgttttcttgaagcggcaatttaaactgttttttattatattgatcactgcggtcgcagcctcagcgcttacgctgtttatcacgggcaatacgaccattttcggacaaggctcggctgctttgacgaacagcaaatttgagaaattcaataaagcctatgagcagattaaaagtgattactatcaaaaaacagatgacagcaaattagtagacggagcgataaaaggcatgatcagttccctggatgatccgtattcttcttatatggatcctcaggaaggaaagtcgtttgaagaaacaatttccgcttcgtttgaaggcatcggcgcacaagtggaagaaaaggacggcagcatcctgatcgtatcgccgattaaagggtcacccgcggaaaaagcgggggttaaaccgaatgaccagatcttgaaggtcaacggcaaaagcgttaaaggccttaatgtaaacgaagccgtcgcattaatccgcggcaaaaagggaacaaacgtcaagcttgtgctgcacagagcgggtgtcggcgatctgaacctgtcgatcaaacgtgacaccatcccggttgaaacggtgtactctgaaatgaaaaaaggagacatcggcgaaatccaaatcacatccttctccgaatcgacggcaaaagagctgaattcagccattgacagcctcgaaaaacaaggagcgaaaggatacattctcgatttaaggggcaacccgggcggcctgatggatgaagccatcaaaatgagcaacatgtttatcgataaagggaaaaatatcatgcaggtcgaatacaaagacggcacgaaagaagtcatgaaagcgacgaaagagcgcaaagtgacaaaaccgacagtcgtcctcgtcaatgacggcaccgcgagcgccgcggaaatcatgtcggctgcgctgcatgaatcatccggaattccgctgatcggcgagaaaacgttcggaaaaggaaccgtgcagacggcaaaagattacagcgacggttctaccgttaaactgacaatcgcaaaatggctgacagcggacggagagtggattcataaaaaaggcatcaaaccgcaatatcaggttaagcttcctgaatatgcgaacctgccgtatttagatgcgaaaaaaacatacaaatacggggattccggaacgaccgtcaccaatgcgcaaaaaatgctgaaagcgctggggtacagcgtgaatgtaaacggcacgtatgataaagcatttgaacaagcagtcaaacaattccaagcaaaagagaagctgaaacaaacaggtattttaacgggagacacaacggcaaaactgatgacggatctgcaaaaacagcttgcggacaacgatacacaaatgaaaaaagccgttgaaacattaaataagaatatgaaatagtaaaaaacacccgatgcgtcgctcgcgcatggggtgttttttgtttgcgaaaagcccgtcttatgtcgtttcctgttcaaaaaggtggctgttcgcctgaatgaaaaactgtgattgctcatagtgataggtgacttttgagaaatcaaacggctggccgttggttaaatgaaaaatcgtttcaacgcaaagcttaggcgctcctgtaaacagacctaagtactccgcttcttcctcatttaacatccccgcgtacagatataaatctgaaaaaccgcgctttaacccgagaccgtctctaatataatcaaatatggattctgccacgatctctttattcaaatacgtaataatggatttgttgtaaaatgactcttcgatacacaatgtcagcccgtcaatatatcggattcgcttgacataatacacgtcgccgtcaggcggcatattcagattttgagcagcctcaggcgtgggttttctcacttccagcgctaataatttggaagtgacattaaaatcttcaagtgattctttaaatccctgattagaaagcagactgatatacccttttcttttattccgtctgacaaaaatgccgcttcccctcacttgaaacacaatcccctttttttctaataaatctaaggacttggttatcgtgcttttgctcacgttaaaccgggtcattaaggtttgcagcacaggcagtttatccccttgctgcagctgatgttcttctatgtatttttcaatatctatcgcgatttgctggtattttaacatatccattcctcattcatttattgtcccgcttctttcagaattatagcataatcgtttttaaaagccatttcgtaaattaactataattgtttatgtattgataaattataccggtacaattataatgtaaacgtataatatgaaaatgaaggcaggaattcttctacacctgcgaagcggtgcttgaagctgctgcagtgcatttattcggtatgcaagcggcagtcaaataaaggaggatataaacgatggggacattgccaaaagattttttatggggaggcgctctggccgcccaccaatttgaagggggatggaataaaggcggcaaggggccgagtgtagtggacgtcatgacggcaggcgcgcatggtgtgccccggaaaataacagatacaattgaagagcgggaattttatccgaatcatgaagcgatcgatttttatcatcgttataaagaggacatcgcattattcagcgagctgggcctgaaatgtttaagaacgtccatcggctggagcagaatttttcctaaaggtgatgaagcggagcccaatgaggaagggttggctttttacgaccgggtgtttgatgaattgctgaaacatgggattgaaccggtaattaccttgtcacattttgagatgccgctgcatttggcgagggaatacggcggtttcagaaacagaaaaacagtcggattttttgtgaaattcgctgaagtgtgttttgaacgctataaacataaggtgaaatattggatgacgtttaatgaaatcaataataagatggatgtgaataatccgatctttttatggacgaactcgggcgtcgccgttaaagaaaacgaaaacgcaaaagaagtcatgtatcaggccggccatcacgaactgctggcaagcgcattggctgtttcgaagggaagagaaatcaatcctgagttcaggatcggcgcgatggtatcacatgtcccgatttacccgtactcatctcaccccgatgatgtgatgctggctgaagaaacgatgagacagcgctttttcttcccggacgtccaggttcgcggatattatccaagctatgcgttaaaagaatttgaaagagaaggctatcagatacactttgaagacggtgatgaagagattttgaaaaatggccgagtggactacctcggattcagctattacatgtccactaccgtaaaaagtgacgtgataaacgataataccggggatgtggtaaacggaggattgccaaacggcgtggaaaatccttatattacagcgagtgattggggctgggcgattgacccgaccggtttacggtacacattaaaccgcttatacgaccgctaccagattccattatttatcgtggaaaacggattcggcgccattgacacattagaagaggacggttcaattcatgacgcttcaagaattgaatatttatcgtcacatataaaagctttggaaaaagcagtcacatatgatggcgtggatgtaatgggctatacaccatggggaattattgatattgtgtcatttacaaccggagaaatgaaaaaacgctacggcatgatttatgttgatcgggataatgaaggcaacggttcaatgaagcggcttaagaaagactcatttgaatggtataaaaaagtgattgaaacaaacggcgcatatgtatcctaaaggtgtaaaaagggaaggcttcaccgttgtgtgaagccggctttttatcagtaattatgaaagcgcattcattaaaacgggaaggaggtgactgtccggcttttcatttagaatcgcttataaaaataaggaaagggatggtggttcatgttttttaaaaaaagtctgcacatgaccctggtttttcttatgtttttctttttcatatcaagcagcacggaagccgaagtgtatgcggctgatcggaaggcttcagacaaaaacaaagtaagggtgtggttcagttctgaaaaagatccggcttcccgtacgtggtatgacgggccgctggaagtgaaatacgccttagacgaacaaacaccgcttacatggacaaaaaagaaggcttctgactccgccgccgtgtatattgatccgtcgcgccgctatcaaagtgtgttgggcgtaggatcgtccctggaagaatccacaatccataatttatcaaaaatgacacccgcaaaaagaaaagaagtgctgaaaaaactggttgatcccaaagatggtatcggcatggacgttatgcgcataacgatcgggacatctgattttacggcacaggaattttatacgtatgacgatatgcctgaaggccaaacagatcctaagctccgtcatttctcgatccaaaaggatattgatttacacattacagcaaccatcaaggaagcgctggcgataaatccggaactgaaaatcattgcctcaccgtggagcccgccggcttggatgaaaacgaatgaaaacctcaagcggggaaagctgaaagataaatatatcggcgcactggccgtttacttccgcaaatttattgaggcgtacgaaaagcagggaattccgatttatgcgatgacccttcaaaatgaacctttgctggaaatcgactatccgagcatgtacatgccgccgtctcaggagcgcaaactggcgatagccgtgaaaaaagaattgaaaaaacacataattgacacgaaaatttggatttatgatcacaatgcgagcggggcgtggaactatattccgccgattttagatgataaaaaaggaaaccgggcggcagacggcatcgcttttcacgattatgacggtgacctttccgtcatgtcggaaatcggaaagagatatcctgatcaatctattcacttaacggagcggtctgtctgggggacggcaggggcggatcggatcgcacagtatttccgcaacggcgcgtcgagctacaatgcgtgggtgacgatgctcgacagtcaaattaagacgcatcattggataggcaccccggacccgacgctgtttattcaggatgctaaaaaccctgaccgctattggaatatcccgatctttcatatgacaggcaacttttcaaaatttatcgagcgcggagccaaacggatagaaagtaattacggctccaaaaacacagtctcgaatgtatcgttccttaatcctgatcaatccattgtgacagtcgtaatcaaccagacatcttcagaacaaaaattccatgtcgtttcagaaaatcggcagtttgaagccgtcatcccggctaaaaccgtcgccacctacaaatggcagcacaaaaagtaaaaaagccggcacatcgatgtgccggcttttttctgttaagcgcctttttggttcagtttatcagagggcgctttattgaataaaccgtctttgacggcgtttgaagacgctttttttacaaaaaacgggttaaggataataacggcagccatgttagcggtcaacccccaaaacccttcatatataccgtgggcggattgggtgatatttaccgtgaatgtcacgataagaccgacgagaagaccgataattgtcgcttctttcgtttgattcttccaaaacagactgacggcgatagccggaaagatctgaaccatgccggaaacaccgagaagctgaagggtaacgagcgcagtcgggaacagcataccgaataaaagcgcgagcccgatgacgacaaataccattgaacgggtgatcatcgtcagcttgcttggtgacacattcgggtgaatcaaatcccgatataagttattcgcaaataagtttgatgctccgatggccatgatagagcagggaatcaatgacgcaagggcgatcgtggagtaagcaaatccctgtgcgactccgccgtaagacgtttgaatcagcttcaataaagcgagccgcggattggtatcttccggaaggacaagaaacgcgataaagccgagaaaaataacaagaatcaaaacaatattataaagcggcagaaacatgctgtttttgcggacggcatctgcgctttttgccgtaaatacaccggttgccgcatgcgcccacataaagagcgccagcgcagatacgatggaagctgtgataaaccaaggaattcctttcggccccgagtccggtatcgtcagcatttgcggcgctttttcagccaaagtgtgaatcatcggcgtccagccgtgaaaatggatcagcgggagtgagacgaccataaacagcataatcacccacaccagaatgtctttaataatcgccgtaaacgtcggccctttaattccgctgaaaaaagtatacagcgctacaagaataaaagagatgatgacgaccatattgacattaatgacacccgttccggccacctgaagcgtatcttgaatcccgctcagctggagacaaatataaggaatgagcataagaacgccgacaatggcgacaagactggccaaaagtttactgtcaaaacgctcacgggcataatcggcaagcgtcgttaatttgtgaatttttgccactttccacaatttcggcagaaagaaataagcgataaaatacgccaaaacagaatacgggattgcaaaaaaagcaacgcttccccctgtgtaggctgtgcttgttaagcctaaaaacgtataagccgtatagagatccgcgccgactaaaaaccagacgaggagccccccgaaccgtctgccgccgacagaccattcctcaacagaagtacgtgatgatttgtctcttccggctataaagccgatacagacaacggttaaaacgatgacggctgtaatgatcaatgctgttatatttgcgggcatcagtccagtcctccttgtttcttctgcagcctataaataagaaacgaacataatggagtgactgcgatccataaaagcagccagaaatgaaaaaagggcagcccgataatgatcggatgaacccgattagcgactgacagcagggccagctggctgaaagggattaagatgagaacgaaaattagtgcttttctgaccatttactttcctcctgaaacttgataatgctccttatcatagcaggtgtcagataagatcacaagatatttttcagaaaaaaaagaattctattacttttttaactgaaacactttagttgcatcttcattcatattaaattagaatagttaatatctcgaaatcaagatatttaggagtgaatacattgaatacacaaggattgcaccatgttaccgcatttgcaaaagatcctgctgaaaatcttcggttttatactgaagtgctgggtttgcggctcgttaaaaaaaccgttaattttgacgacccggccacttatcacttttatttcggcaaccaaaacggagagccgggcacgatcattacattttttccttttcagggaagccgcccgggaaccgtgggaaaagggcaggccggaagaatttatttctccgtgccgaaaggagcactcgcgttttggaagcgccggcttgaagaaaacggcttgtctgtaaaagaacagatcatgctgtctgaacaagtccttctctttaatgatacagaagacctgccgcttgccataatggaagatgaaagaagcggacagagtgaatggactccttcgggcattactgaaaaagaagcgatcacaggcatgagaggtgttcttctgtactcgtaccgtcctgaagcaaccattcaatttctcatagaacgcttcggttattcaaagacaggagaagaaaatcaaattgtcaggctgcaatcggaggcaaggatcggacatattatagatgttgaccttgcgccgaaagaagcaggtgccggcggttacgggacagttcatcatgtcgctttccgcacgagcgaaaaagagcaggcggagtggaaggatattcttgctgattctcatcttgcttcatctgacattcttgacaggtcatactttacttcaatctatttcagagaaagcggcggcattttatttgaaatggcaactgacgaaccgggctttatgacggatgaatcctttgaaaatctcggaacagagctgaagcttccggaatggctggaagagcatcgcagtcagattacagctgttctgcccataatggagaaaggagaatgatgatgaaacatgtgtttgaacagggaacgtcagaaaatgttctgctgcttttgcacggaacgggaggaaatgaacatgatcttctgtcgctcggacgttttatcgatccgaacgcaagtctgctgggggtcagaggatcagtgtcggaaaacggcatgccccgtttttttaagcggctgaaagaaggggtatttgacgagaaagatttaattgaacggacggaagaattaaagaattttattgatgaagcggcgcaaatgtacgggttcagcagagaaaacgtgattgctgccggctattcaaacggcgccaatattgcagcaagtcttttgtttcattataaagatgtactgaaaggagcggttctgcatcatccgatggtgccgatacgcggagtgaagctgcctgatatggaagggctgcctgtgtttatcggtgcgggaaaacgcgatcccctatgtacaaaagaagaatcggaggagctttatcagtatctgacagatgctcatgcatccgttgctcttgaatggcaggagggcggtcatcagctcacacagcaggaagccgagcaggcacgagcctggtacagtgagcgattcctataaaaaacccttagtctgcttaagcggactaagggtttctttcatcttacagccaagttgacactttagatacaggcagccggttgcttttatgcgccggcttaacggctttaccgattgaaatcagcatgacgggcacgaaacgctcgctcacgtcgaattctttaacgaattgctctttattgaatccgccgatcgcgcaagtgtcgtagccttttgctttagcggcaagcatcagctgcatcgctgctaaagaagcgtttaaaaatgctgaatcgcgggcaaactgatcattttggtatgcaccgttaatctggcctaaaagcgtttgtttaatctcttctgtgatattgccttgctcagccagttcagcataaacgtcttcaccattttcatttgcttttaagtcgcctaatacggcaataactgctgatgaatcaataatctgtttttgattaaaagcaaccggaagcagggcagcttttgcttcatcactgtgaaaaacttgaaaatgccaatgctgaaggttccaggcggaaggcgcttgcgttgtgatttcaaggagttctgtcaattcctcttttgtaatgaccgcgtctttatcgtattctttaacagatgcgcgttcctttaaaacgtctaatacggatgtcatcatgtttcctccttcggataaacgtgttatcataatagaaaagttagaagcttactaaatgtaacttgaaaactaattttaatggatcacaaaaaacttgtcaattcatagatgaagggatgaattcacgtgggatatacaatgtgtcctaaaatggaatccgctttttctcttttgggaaaacgctggaacggcctcattatccatgtactgatggacgggccgaaacgatttaaagatatgaccgaaacgataccgacaatcagtcaaaaaatgctcgcggagcggctcaaagagctggaacaaaatgaaatcgtcgagcgtcaggtgctgccagaaacacctgtcaaagtcatttataaactgactgataaaggcatggcactgcaagccgtttttcaggaaatgcaaaaatgggcagacagtttttgcgagcccgggggatctgccaacgacacatgtgatgaataataaaggctgcccaaggcagccttttcttaatgataatgtttaatcgtcataaaaaccattaatatcaaaattgttcagattgaggttcaagccttttaattgatttaataaagcatcgaatgtaaggaaatgatcatttttacattccgccggaacatcatctggagaaaatagttccattcctccctcaatccactgtttccggtataactgaaatgccgcttcaattaaatgatcaggcgttacaataaaccctaagcttacgtcatggtcctcactgtagccgaattcaaacccgcagcaagggcagatatcaaatgttttttgatattcgccgttataaacgggacttgtctctaatcctttaaatccgcatatcaaacaaggatacaactcactaaccaacatccatccctcttttattcagtttgaaaacatccaaaacaagcagggaggccttttacagtttcccggttaaaaactgagcctcaccgagcccgaagctccaatcggcgttcccgttttctgtaacggaaatcatgacgtcctcgggtgatatgccgcattctgttttaagctgatcagccatcagttgatataacgtttctttctgatgttcggtgcgcgctttgctgacaatgctgatgatgacaagagctttgcttcttttgaaaccgagcccggtatcttcaatgataagctcatgaggccgatgctggtgaacgatctgataacggtccgttactgggacgtcaaaagctttaaccatggcgtaatgggcggtatccagtaacttttttaatgctgcgtcatcccggccttcaataacgtcaaaacgaagtaatggcatattttattcccctgatggttttataatatcgtaacttgtaaaaaaagtataacagttaatcaaaatataatcaaattataaccaaaatgtttacatattaatgcaatattaaagagaggcacatgttgttacaatcgcccaatcaatttcctcattttatgaatacgcttaagaataggcagacataaaggaggaaaaacatgtaccctcgtcatgcattgtatcgcgggaatttcggtcctgccggatttccggcgagaagtccttttttgttcggcgctcctttattcggcggatttttaggcggtcttctcggaggcgtgattgccacaggttttacaagaccccgctatccgtacgggtttgccggttacggatacggaggcgtcccatacggcggtttcgggccgggagccggcggttatccgccattttattaagaaaaaacggcctgcatcgcgcgggccgtttttttatcttaaaatctccacttccgatagattgtagtcttcctgttttgaaaacataacttcaatcatcccgtctttatagactgcttttgttcctttccgtttgacgaggctcggaagtacgatttctttttttccttctcccaggctgctgttctctacaacgaggctgtgtgacgtatgcttaatcctgatacggtcgagttcctcttgttcggcgggaattttcgcaaaaacatgatcggatgtttcaaacaggtcaatttccggcttgggcggttccgcttcgaccggatcggcctttttggacatcgggtcgcgaaaagggaactgtccggcataaccggcgccgaatacgctttccatcactcggttgacatatgtctcgacatctttcggatcagcatttttaaacgtttctttagagaactgattttggaagggaaaatatctgttccaatcaaacacggcatctcaccctttcttaacggacaacatagtatatgcccgccggaagcttcccgtgatataatataatctgtttacagaaaggaaggggaaggccgtgcaagggaataacgtaagaaaaggaatcatttataccgcttgttctttcgtcatgtgggggctgtttccggtctattggaaacttcttgaacaaatacccgcattggacattttagctcaccggattttatggtcatttgttttcatgtgtgtgcttttaactgtgcttaagaagtggaaaaccggatggcgtgaactgcgtcttttgaaatcggaaggggcctgctggcgctttttttcgcttccgttttaatttccgttaattggtttgtgtacatatgggccgtcaatcacggctttttgcttgaagcaagtctcgggtactacattaatccgctcgtttccgttcttttgggcatcctattcttaaaagaaaagcttaacaagatgcaaacagcagccgtttctattgccggggcggccgtgctcatatctgcgtttcaatatggcgcggttccttatatcgcattgctgcttgcattcagcttcggtctgtacggcttatgtaaaaaaagaacccgcatgtccagcacgatcggactgacgctggagacgcttttgattaccccggctgcacttatttatttaggatatacagctgacgggagcacttttgggtccttggggcaggaacatgggcgctcctatttttcgcaggcgtatttacggccctgccgctgttattgtttgcagagggggcaaagcgtctgccgctgtatcaagtcggcattttgcaatatatagcgccgaccatcacccttatgcttggcgtatttgtgtatcatgaaccgttttccgggcaaaaagcgtttaccttcatttgtatatgggcagcattgcttttgtttaccttttcacagataaaatggaagcggccgataaaaagccgctaagcctttcgctttccagcgatagcttaaattatgtataatcattacgagtatgtaaaggagctgtacaatgggcactgataaagacatagcaaaagcctatcaggcactgtggaataaccgcactctcccggcttcaacccttgaagaagcggaaaaggcgattgatcttgaactgcttgatcaaagaacacatccgaggctccggaagtcacccgaggaaaagtttgctctggcggtgcagcgaattgtagattcccggctgcggccgattgagaaatatgaattggttgaactacatacgaagcgtttgcaatttttaaaagaagaaagaggggagcagctatgaaagcgatcataaaagaagatgtgcaaacttctttagagcgatatgccgatcgtcctgtatatatccatttggaaacaacgaccggttcttattcagcgcatctgaatgagaaaaatatgacggttgtagcctatatacgcaatgcaaaagtgacgtaccatcaggcgaaaatcaaaggaaacggcccgtaccgcgtcggtttgaaaacagaagagggctggatttacgcagaaggtttgactgagtatacagtagatgaagaagaccgtttgttaatggcggggcatctgccgggcggaaaattggcgatttcgcttcaaatcagcgaaaagccgtttacagtttaaagaaaagggtgaaaatcatgaaagaacatgtactcgtcatcctgcctcaccctgatgatgaatcatacggagtggcaggactgattgctttacacagacaaaaagatattcccgttacgtatgcatgcgcaacgcttggcgaaatgggccggaacatgggagatccctttttcgcgaaccgtgaaacactgccgctgttaagaaagcaagagctgattgacgcatgcaaagcaatggacattactgacctgagaatgctcgggcttcgtgataaaacacttgaatttgaagatgacgagtggctcgcggatatgatggaagagattatcgacgatgtaaaaccgagtctgattgtcacattctatccggagcacggcgtccatccggatcatgatgcatgcggcgaagcggtcatcagagcgctttacagaaagaaaaaagaggaccgcccgcgcacgctttgcatggcaatcacccgcaacagggaggaagccgtcggcaagcctgatgtcattcttgatattaaagaggttgccgatattaaaatgaatgccttaaaagcgcaccgcacccaaacggaaggcatgctgagagagctggaagaaaaattaaaaaataacgagccggttcttcagacatggtttgaagaagaagtgtattggacatatccgtggaaagactgataaaaaaagggataaggctgaaatgccttatccctttttttgtgtcagatcggaagcgatcgcttccgcaagcgaagaccgtattgataaatttgaaaaactcagtccgagctgcaccgcggtttgggcgatttcaggacggattccggataacgtcgctttcacgccgagcattccgagtgattcaattaaggtgaaaagctgttgggcaaccatcgtatcaatcatggctacgcctgataaatcaatgtacagctgcgtgatgcgcttctctgaacactggtgcagcgtattctccaaaatcattttggctcttgccgtgtcaatatccccgatcagcggcagcagtccgacattgtcaaaaagcacaattaccggcgagctcagctctgtaatcaattctttttgcgcttcaagctgaatgtttgtgtttttatacatttcctctatgaaaatatgaatgaccacatcaaacgatttaatcagcgtatggaatatatcttcggcatcttcttctgtcacggtgtctgaatgaagtctggtaaactgctttacatggccgacatacaaatcacgaactctgataaactcgcgaatgatgtaatggatgggagtttttaaatgttctttatcccgtgcggcttcaaacgcccacttttccaatgccgctgtatatacttccttctcttcagaaaaaatccgattgagttgataattaaacgccagattttgttttttcagatttgtgagaacagccgggtcagtagaagcataaacagaatcaggatccgtatcatgaagggtatcaaaccatgtctgactgatatcctccgcccgttcggttaaataatcgtacagcagtttatgtttcggcattgctgctcctcctttataaaatcatcatttttttcacataacgcttttgcagcttcatcagtctgaagaataaaccgacagctcctgcggcaagtcctgcaattaacccgatccagtagccgtatgccccgaggctcgtgtaagtgccgactgcgtaaccgagcggaagcccgataatccaatacgaaacaaaagccgcaccgagtgtatagttgacatccttatatcctctcagggcgccttgtatcggagctgctacggcatcagaaagctggaaaaacagcgcatagattaaaaagtgctgcgtcaacatgagcacctccggatctgatgtatacattccggcgatttgcggcctgaacagtaaaatgaaagccgccgtgcataaagaaaaacaaagggccatcacaatgccgatatagctgtatgaccgggcatccctgtaacgctttgcgcctgcttcaaagccgactaaaatcgtcatggccatggatacgctgagcggcagcatatacaagagggaagcaaaattcattgccgcctggtgggatgcaatcgtcaccgtccggaaatggctcattagaagtgtgacagccgcaaaaatgctcgtttcaaaaaataccgcaaaaccgataggcaaaccgattttcaaaagttttctgcattcagacggagaaaaacggtacagtttccgaaatacagagtacccggcaaacggctcaaatctgaagacgataaaaaagctgacggcgcaaatacaccagtaagtcagggcggaagcgagccccgcaccgactccgcccaatgccggcatgttgaatttcccgaaaataaatacataatttaaaacaaaattaataggcaatgagcaaagcgtaataagcatcgtgactcgcgttttgccgagtgcgtcaatgaacgagcgcaaaacggcgtacacaaacaaaggaaaaataccgagggataaaaagcctaaaaagtgtttggcgatcgtccggacacgaggttccaggcccaaatgtcccaagatcatatcaacggtgaaaaagccgaccaggataaccgccgcactgagaatggccgctacataaacggcctggatgacggaaaacggcacttccttttgtctgccggctccaaacagctgcgaaacaacgggcgtaacggccattaatattcctgcaaggcccgtatacaccggcgtccacaggcttgaaccgattgcaacaccggctaaatcggcggcgctcactttccctgacatcaccgtgtccaaaaaggtgatcagggcaaggcccgcctgtgtgattaaaatcggaatgaagatatgtaacagctgtctgaccttttggccgatcgtgttcgtttctctcaatttaggttccccgtttctttattttaacgagagaaattataacattttatgtataaaaagcaatgaaagccggcctactcttttttatccggtttcggctttttaaacatcttggcataaatgaatgaaagtgaaatgacccctaaaaaggtgcagatatattgcatcagccgtgcaaattccatatgatttcgcctcctttcatgattatggtgtacacagcggcgcatatccatgcgcgcgatgcagaaaataagggaaaggagatgatgtgacatgcgccacactcaaatgacggaaagcgcgtttaccgctgccgttcaaacgtacttgaaacaaattaccgaggatgccggaatgatactgcggacattggatgaaaaagaccaatgccttctttgcgaattagatgaactgggacatacgtttcaggaaatgcaggctgtcgcttcgtcgttttacctgcagtcatatatcgaacattttacgccttcctatacagagctggcgagggccgtgcagcatctggcggaagaaaagcacggagcgctgattgtgattgaacgtgcagatccgctggacggaatgatacaaaaagggaccagcctgcatgccgagatcagttcagctttaattgagagtattttttatcccggcaatccgcttcatgacggagccgtattggtcagagaaaaccgggttgtatcagcagccaatgtgcttccgctcacaacaaaacatgtcgatctcaaatacgggacgcgccacagggccgcgatgggactttcggccgtgactgatgcactcgtgctcgttgtttcagaagaaacgggaaaaatgtcttttgctaaagacggcggactgtatccgcttgtttcgccgcgggcgcttcatacgaaataataagaaaatgggaatattgtacccatttaatattaataaggtgaacatctttacctttttctgtattggtgttatcgtttaaatatacataaaatttaaaagaatagggagtggaaagatggcaaatgtattgatgatcggctttccgggagaaggccatatcaatccgtctttaggcgtcgtaaaagaactgaaggcaaaaggggaacatgtcgtatattacggcgtgaaggaatatgagcacaaaatcgcgtcaagcggagcggaattccgtgaatgtgaagatttccgaaaagatgaattcggaaaaaacgcaacgggtgatgaacagcgggatgctaccgagtttttactgttaatgattgagacttccgaaaaagccgcactccgtattcttgaggaagtaaaagatgaatcatacgactacatcctttatgatcatcattttctggcaggaaggcttgtgagaaataagctgaaactgccggcatattcactttgcacaacatttgcaatgaatgaagcatttattaaagaagtgttttcaaatacaaaccttatatcagaggaatcatctcattatccggcttataccgaagcggtcagccggcttaatgaagaattcagcgcagacattaaaacgccgtatgatattttctcaaatgacggcagaaaaaccatcgtatttacttcaagagcgtttcagccgaaagaagaagagtttggcgattcttatctctttgtcggtccgtccataactgaaaggccggcggctcaggatttcccgtttgaccagcttgaaggagaaaaagtcctgtttatttcaatgggcacgatttttaacaatcagaaggaattgtttaataaatgcttaaaagcggtcaggaactttaacggaaaagccgtcatgtcaatcggcaaacatcttgatccggcggagcttgatgaaattcctgagaatgttattgtaaagccttatgttccgcagcttgagatcctgaagagagcggacttatttatcactcacggcggaatgaacagtacgagcgaagggctttactacaaaaccccgatgatcgtcattccgatgggagcagatcagttcgccgtcggaagccaagtggaaaacacgggcgcgggcaagatgtttaaaaaagaagatgtaacagcggaactgctcactgaagcaataaaagaattgagcgaaaatcctgaatatcagacaaaagcttctgaaatcggagaatccctgaaagcggccggcggagcacagcgtgcagcggaattgatagcagaagacgtgaaaactgccgagacccgggttctgtaatcagccgtcacccgcttcctttataggaagcgggcttttttttgtttgtttttcgggaggattttcacgccgtgaagagaattgtatgaaaaacagacaagaaaggtggaatgtcgcggaaaaaagccatgttatgaaaatgattccaaagtcttttgtgaaatgttctcaatttatgtaaaatgtgtggcattggtgatgatctaagaccaaatgaatcggaattaatgtcgacttctgaatgaatcctgcataacaggcggcgtccaaagaaaaggaacgtccctttcagcaatgataaataggaggtttttcgttatatgaagaaaaaaatcgcagccggactggctgtatctgcagtaatgacttcaaccttcgccgtgcatcccgctgaagcaaaaaccattcaagtaaaaagcggcgactctctttggaagctttcccggcaatatcatacaagtatttcagccctgcaggcggaaaataaactgaaatcaacgatactccacccaggacagcggctgcacattcccgacgggagcggcacacataaaacggggcaaaaaggaaaacgaaacactggtgcttacacagttacatacggagactcattatgggtgatcgctaaaaaataccgaatgagcgtttctgaactgagaagcctgaaccgtttgagttcagatatcatctatccgggccaaaaactgaaaattaaagggtctgccggcggcacggacggaggcggcagacagacaaagcctgataaaggcgcatcagggacttacactgtgaagccgggtgactcgctgtggaaaatcgccaatcaaaccggcatcaccatcgccgaactgaaaaagctgaatcaattaacatcagacatgctgtatccgaatcaagtattaaagatcaaaggttcttcacataacggaaacagcggcacaacaccgccatctcattcaaacccttctgagaagccatccacttacaaagtaaaagcaggcgattccctctggaaaattgctaatcggttcggcatcaccgctcagctcatcagagaaaaaaataaactgacaactgatgtgcttcaaatcggacaggttctgttgattaacggaacgggaaaaacagaagatcctgtgcggcagccgggtaacaaaccggcaaagccaaacaagccaaatactcccgaacctccggtgacagggtcaaagattgacagaatgataggcgaggcgaaaaaacatgtcggcgtgccttaccgctggggaggcaatacgcctgcgggcttcgattgcagcggttacatctattaccttttaaataaggtaagctctgtttcccgtctgagcacggccggatattggaatacgatgaaacatatcagccagccgtcagcaggcgactttgtcttctttacgacatataaagcgggcccttctcatatgggaatgtatttaggcggaggagattttattcacgcaagctcctccggggttgaaatttcaaacttaagcaatccatattggaaaaaagcttatttaggagcgcgcagttatttttaaaaaaaagcctttcggggctttttttgtttaccattttcacgttttgacaagactgatgggtaaaaaaataagggggaggaagcatgaatcgtctcttgctttttctcatgctcgcatcaattacgctttgcggctgcggggcgagacccgctcctgctccgcccaaaaaacatggggaaagccgcgcattggaagcatctgcataccgtgagcatgccggactcatcaatcaaaacggaaaaacgatcggatatatcgaagtgagggaatctgatgatgaaggatcagacattcatatatcagcgggacatctgccgcccggcgcttctctcggatttcatatttatgaaaaagggacatgtcaggcacctgatttcgaatcagccggcggtccgttcaaccctttgaacaaagaacacggcttcaacaatccgatgggtcatcacgccggagatctccccaatcttgaagtgggggctgacggtaaagtggatgtcattatgaacgcgccgcaaacttcattaaaagaagggagcagactcagcctgctcgaccgggacggaagcgcgttcgtcattcatgaacatacggacgattatttaacaaacccgagcggaaattccggagccagaatcgcctgcgctcccctgacaaaaagcgcccgcagggaatgagcccttttgtattgagtatacaagggcttttttagtatactcggttatggaatacaaatggaaaggaaacatcacctatgacttcagaattacagcacctatcacttccggaagatatacaaaacaaactgcaggcttatcaaaatcatcccgtttcccaagaattccgggatttaatcggatcatcaggctatgaggccgaagataaagcgattgtattcgatgccgtcatcgctttgacaatgggaaaaaatatcttattaaaaggaccgacgggttcgggaaaaacaaaattggcggaaacgctttcgaactattttcataaaccgatgcacagcgtcaactgctccgtagacctcgatgcagaagcgcttgtcggctataaaacgattgaaaatgaacaggggcaggcgacaattgaattcgttcccggacctgtaacaaccgcaatgaacgagggacattttttatacattgatgaaatcaatatggcaaagcctgaaacccttccgattctaaacggcgtgcttgattacagaaaaatgatgacaaatccctttacaggagaagtgattaaggcaagcgaaggattcggtgttatcgccgcgattaatgaaggctacgtcggcaccgttccgctgaacgaagcccttaaaaaccgttttgtcatcattgatgttccgtatattaaaggaagcctcctgaaacaggtgctgacctctcagtctgtcttaaaagatgagaaattaattgagcgctttatgacgctgtcttctgatttaatcgcacaagcgcataacggacaagtgtcagaagaagcggcgtccatcagggctctcatagatacgtgcgacttggctgcgtacatcccgccgaaacgggcgattgaaagaggcatcgtggaaaaacttgacgacgacagggaaaaagccgctgtcagaaatattgcagaaacgctgttcgaatgagggatatacaatgaagtttatcaaatttaacgacagcacgattgattcgtttttgttcatgatgctgactgatctggccaaaacactgaccagaagcagtgaagttgaagtggaatacggcgtgcagtcttactacaatccctttgaaaagaaaatttacatgagccacttttggaaagaccgatcagccggggatatggaagccggcctgaaaagcgatgtctatttgcgcgctgtcggaacacgcagcagctcatttcgggtatttgcggggtttttaaatgacgttcaccggcacttcacccgccaaagctttgccaagcagctgtttatgctgcttgaggatatcagaattgaagagcagatcaaaaaagaacggccgggaacgaaacgtgtttttcagaagcggagggagatgtacaggaaatatttcacgacgcagctgacattgaatttagaacggagcattttcaccgacgctttgtattgcgcgatgtttgtcaagctgacggctgagtctccgcttgaaggcattccttccatgcatgaaaatattgatatgatgataccgtatattgaacgtcagctcatccgggtgtatgaggcggattctacggaacaaatcgcaacaataacggaagacctcatggaaggccttgatgaagtgcttgagaaagatatgctgaacacatacttttttctgccggaacttgattacgaaaaagcggctgaagagcctttattcgaaagcgtaaaaaaagcgccttcgttaagtgacgatctcacgctccctgagtcttccgacggagatgaagaaatccttgaagagaaaatgaatacgtggcaccgggaaaccgaagcgccgtcaaaaagcttccttcaatttgatattgagcacggcgcgaaatcagatcttgggaaagacgcggccagagaaggcgatgacggtgaccaggcgctcggctccgttcaaggttccgcacgtcagacgaaaagagaggattactctaaactggaagcgcttgaatccattcaggatgaacatgagggcgccgggctggctgacggaaaagaaaacaaatttgccttcccggtttatcaaacgcctcaaaaagcgtctcctgaagaggagcagtcttataaagaacaggcaaaaacgatagaatcatatcaaaaacgcctgaagcagatgatacaaaaaacacttgagcacaaaaaaacgctcccgcggaccgaccttcacgcaggccggctgaatcgcaaactgatccgctattttacggaacggaacccgcgccttttctataaaaagcaggacccgtcttcagacattgacgccgtttttacattgcttgtcgattgttcggccagcatgtttgacaaaatggatgaaacaaaaagagggatcgttctttttcatgaagccttgaaatcagtgtccgtccctcaccaaatcgtcggattttgggaggatacaaacgaagcgaccgaaacgagccagccgaatttcttcaataccgtcattccgttcgaagagtcgctgctgcaggctgcgggtccgctgatcatgcagcttgcgcctgaagaagataacagagacggatacgccatcagacaaatgacgaaacagctgatgcggcggagtgaggcgcaaaaatttttaatcgtgttttcagacggagagccggcagcattcggatacgaacaaaacggcatcgtcgatacgagcgaggctgtcatcgaagcgagaaaaaaagggatagaagtcataaatgtttttctgtccaatactgcgatagaagaatcccagatgaaaaccattcaggatatgtacggaaagtacagtatttttgttccggatgtcgatcagctgcccgatgtgctgtatccgcttttgaaaaaactgcttcataaaagcataggataggctttttcctatgctttttcgctttttattttaaaatgatttaattttttcggtattgatctgttttttttactattttgtgaacaatcaaggtagaatccaaacgcaatcagtggtaaaatatccttggaagcgtttttattacataattttgggcacagcgttcaaaagttatttcaagatagtgaattgatcacttgattatctaggttgggggtaatattcaaatgtttcaaaataatatgaaacaaagaatgaattgggaagatttttacggaccgaacctcggctacgcactggagctgtacgaccaatatgctgaagatccagacagcattgatccggatctgaaagacatgtttgacgaactaggcgctccgccaagccaaataaaagaggcatcggaaacaaaggaacagggacgcgtcaccgcagatctgattcaaaagatcgcagcagcagttaaacttgcagaagatattcgaacctatggccatctgaacgcttccgtcaatccgctcagaaaggatccgaaaaagagcgagctctttccgttatccgagtacgggcttacagaagaagaaatgaaagcaatacccgcgtctgtcatctgtaaagacgcacctgccaatataacaaacggcttagaagccatccagcatttacgcaatacctataaaagaaccatctctttcgagtttgaccatgtgcatgatttcgaagagcgcgcatggattacaaaaatggtcgaatccggcgaactgttccggaaaaattcaccggaaaaactgtcagccgttttagaaagactgacggaagtagaaggatttgaacaatttttacaccggacattcgtcggtcagaagcgtttctcaattgagggattagacgcgcttgtgccggttcttgacgacattatcgcccagtctgtgaaggcgggcacaaccaatgtcaatatcgggatggcgcacagaggccgtttaaatgtgcttgcgcatgtgctcggcaaaccgtatgagattattttctcagaattccagcacgcgccgaataaagaccttgtgccgtctgaaggatcgaccggcatcagctacggctggacgggcgatgttaaataccacctcggtgcagacagacagcttcaggatgctgaaaccaaaagcgcgcggattacgcttgcaaataacccgagccacttggaattcatcaatccgattgtggaaggaagcacgcgggcggcacaggaaacaagaacgcaaaaggggtacccggttcaagacgaaacaaaatcgctcgccattttaattcacggtgacgcagcgttcccgggagaaggcattgtcgccgagacgctgaacttaagctcactgaaaggctatcaggtgggcggggccattcatatcatcgccaataatatgatcggctttacaactgaaagcgatgaatcacgatccacaaaatatgccagtgatttggcgaagggctatgaaattccgatcgttcacgtcaacgcggatgatccggaagcatgcctgtcagccgttaaatttgcggttgaataccggaagcggttcaataaagatttcttaatcgatttaatcgggtacagacgatacggccacaatgaaatggatgagccgtcaacgacacagccgatgctgtatgatgccgtcagaaaacacccgactgtcaagcggatctttgcggaaaaactcgtaagtgaaggactgatcagcgaggaaaaagcgcaaaacatcgaaatggcagtgacaaaacgaattgaagacgcctataaaaaggtgcccgccaaaaaagaagacgccgtacgggaaattgaattgccggagccggtgtccaacggttttccagacgttgacacagccattgattttgatgttctccgcaagctgaatggcgaacttatcaactggccggaatcctttaacgtgttcggcaaactgaaaagaatcctggaaagacgtgcaaaagcgtttgatgatgaccgtaaagttgaatggtcattggctgaatcgcttgcgtttgcttccattttgaaagacggcacgccgatccggctgaccgggcaggattcagagcgcggaacgttcgctcaaagaaaccttgtgctgcatgacagcgaaacaggagaagaatttgttgctctccatcacttagacgactgcgcttcttcatttacggtgcataacagcccgctctctgaaggatcggttctcggctttgaatatggatacaacgtgtattcgcctgaaacgcttgtgttgtgggaggcgcagtacggggactttgccaatgcggctcaagtctattttgatcaattcatatctgcaggacgggcaaaatggggacaaaaatcagggctggtcatgctgctgcctcacggttacgaagggcagggccctgaacactccagcggccgcgtcgagcggttcctgcagctggcggcggaaaacaactggacagtggccaacctgacaagtgcggctcagtatttccacattttaagaagacaagcgaaaatgctgcttcgtgaggaaatccgcccgcttgtgatcatgacgccgaagagcttgctgcgcaacccgaatacggtatctgaagtgcaggaactgagcgaaagccgattcaagcctgtctatgagcagtccggtctttcccatgcttacgaaaaagtgactcgcgtcgtattatcaagcggaaaagtgtcaattgatatcagcgatcacttcaacaaaatggaaggcgataaggattggcttcatattgccagaatcgaacagctgtatccgttcccggcaaaagatacgaaggagcttttcgccaaactgccgaacctgcaagagatcgtttgggttcaggaagaaccgcagaacatgggggcatggagttatatcagcccgtatctgacggaaattgcgccaaaaggagtaaatgtccaatacatcggccgaagaagacgatccagtcccgcagaaggagatccgacagtccacaaaaaagaacaggaacgcattgtatctgatagcttgactcgcaaaaactaagggggaaatgtaaaaatggcggaaattaaggtacctgaattagcagaatcaatctcagaaggaacgatagcccaatggttaaagcagcccggtgattatgtagaacagggtgagtacttgcttgaactggagacggacaaagtaaatgttgaattgacagcagaagaatcgggtgttctaaaagaggtattgaaagattcgggtgataccgtccaagtaggagaaattatcggtaccattacagaaggcgctggcgaaagttctgcacccgccccttcagaaagtgctccagccaatgaacaaacgaaagaggaagcaaaagctgaacctgctgcacaagaagtcagccaggaagcacaatcagaagcgaaatccagaacggtagcgtctccggctgcacgcaagctggcaagggaaaaagggattgatctatcacaaattccgacgggggacccgctcggccgcgtgcgcaaacaagatgtggaagcttatgaaaaaccggcttcaaaacctgcggcacagccgaaacagcaggctcaaaaaacacagcaaagctttgacaaacctgtcgaagtgcaaaaaatgtcccgccgcagacagacgatcgcgaaacgattggttgaagtgcagcagacttctgcgatgctgactacatttaacgaagttgacatgacggccgttatgaatctaagaaaacgccgtaaagaccaattccttgagcaaaacgatgtaaaactcggtttcatgtcgttctttacaaaagccgtcgtggctgcattgaaaaaattcccgctccttaacgctgaaattcaaggcgatgagctgatcgtgaaaaaattctatgacatcggtatcgctgtcgcggctgaagaagggcttgtcgtcccagtcgtacgtgacgctgaccgcctgacgtttgccggcattgaaagagagatcggcgaacttgcgaagaaagcgcgaaacaataaattaacattaggtgagctgcaaggaggctccttcacgatcacaaacggaggtacattcggatcgcttatgtcaacaccgatcctaaacagccctcaggtcgggatcttaggtatgcacaaaattcagctgcgcccagtagcaattgatgcggagcgctctgaaaaccgtccgatgatgtacatcgctttatcatatgatcacagaattgtagatggtaaagaagcggtcgggttccttgtcaccattaaaaacctgcttgaagatccggaacagctgctgctggaaggataatttgaaacagacaaaaagtacactgcccttacaagcagtgtacttttttattgagcgaaggggagaatttatatgaaaagctgttatccgcttgagatcgaatttgaatataatgaagaattgcattctatcactccggttcttctgcaagacgaacatgacacgatattaatagactgcggatatcccggttttacaaaccatcttcaacatgctgctgcccggcatggaatgtcgcttcattcattgacaaaaatcattgtaacgcatcacgacatagaccatatcggctcactcgctgcattacatcgtttgcacccggatatcagcgtgacagtacatgagcgtgaagcgccgtatattgacggctctaaaaaatctttacggcttgagcaggctgaatcaacgtttagttcattgccagaggatgcaaagccttatgcaaaacagttcatttgctcgcttcaatcagtcgaatcggctccagttcaccggacagttactgacggtgagctgctgccttggtgcggaggcattcgcgttgtagccacgccgggtcatacacccggccatatcagtctttatctgcctgccgaaaaaacaatgatcacaggtgatgcggtcgtcattgaagacggaaagctgaaacttgctaatcctgactatacgttacatatggatgatgcggtccgatctgtgcagcggctgcttgattacgatatccgccaattgatttgttatcatggaggtttatttcagggggatgtaaaaaaagcgcttttgcgcctgtttcgtgatctgcagaataatcaaggataggagcggcggcagcctatccttgttcagttatgaaaacggaatctttgccgtttcttcttcggcgctgtttttctcttttttcttagaccagtaggtggcaagaacagaccccgacagattgtgccatatgctgaaaattgcgctcggcacggctgacaaaggggagaaatgcgctgtcgcaagcgctgcgcccagtccggagttttgcattccgacttctatcgcaatcgctttttgtgaagcataatccattctgaacagctttgcagtcaggaatcctaacaaatatccgattccgttatgtaagatgacgacagacacaatcagcagtccggattgaagcagatgctcacgatttacgctgacgacagaggatacaatcgctacgatgccgattaccgatacgagaggaagtgcgtgcacggcttgtccgacctgttttttgaagaacagcttcacaatcaccccgaggacgatcggcaaaagcacggcttgcataatggaaacaaacagtgaaccgaaagaaacgggaagccactctttcgcaaacagcataataagtgccggcgttacaataggagcaagcaatgttgagatcgtggtgaccgcaacagaaagcgccgtattgcctttcgccaaaaacgtcatgacatttgatgccgtaccgcccggacagcatccgaccagaatgacgcccgcggcgatttctgcggggaggcggagcccgactgataaacagaaagccgcaagcggcataatcgtaaactgggcagcgactccgatcacgacatgccaaggctttctgattaattctttaaaatcgtctgcttgaagagtaagccccatcccaaacataataataccaaggaaaatcgtcatataagaactgatccaagaaaacaaatcagggcaggcgaatcccaaaccggcaaagacgataacccacaagccaaaggtttggcccgcaaacccgcttatttttttcagccattccataaacacagctccttttacatccaatcaatcagtcagaaaatatgactgacttttctgtactccattataaataatattctgaataattcaatattaaatataagttttcgataaaattattatgtaaactaatatcttcttgactattcagacatatattcttacaattgatttttatactgaaatgaattgggagtgctgaagtgaaagaagctaatcaatggtcatctaagctgggatttattttagctacggccggctctgcaatcgggctcggcgcaatatggaagttcccttacgtagcgggaaccagcggaggcggcgcttttctgcttgtttttattttatttactgttttaatcggactgccgcttttgcttgctgaatttattatcggcagaaaaacacaaaaaaacgccgttgaatcctataaggcgctggcgccggggaaaaagtggcactggatcggatatctcggaatcataacgtgttttattctattatccttctacagcgtagtgggggatggatattaatctacattataaaaggctttacaggcggtttaacgctttcttcgggatttgatacgttatttatcgataccatttcaaacccttatgcagcggttttcggtcagctgctgtttatcgtgctgacgattttagttgtggcaaaaggggtgagcagcggcatcgaaaaggtaagccaggtgctgatgccggctctgtttattctgtttattcttttaatgatccgctccgttacgctgcatgatgcagcgaagggattaaaattcttcttcatgcctgattttggcgcgatggatgccaataccattttatatgcgatgggtcaatcatttttctcgttaagcgtcggagtgtccgtaatggttacatacagcgcatatttagaaaaagaagaaaatattgttcaatccgccgtatcggtgacggtattaaatgtccttgttgccgtgatggcgggagtggcgatttttccggcggtatttgcattcggtctcaagccggatcaaggtccgcagcttttatttaacgtgctgccgaccgtctttaaccaaatgccgttgggcatcgtgtttttactcgcctttttgctgctgtttttatttgcgacgctgacatcggctttttcaatgcttgaaattttagttgctgttttgtcaaaaggcgattcggcaaaacggaagcggtatgcatggatcgggggacttgctatatttattgtcggggtcccttcggcgctgtcgtacggcattttgagtgatgtttctatttttcaccgcagtatttttgacgctgcggattttctggtcagcaatgtcttaatgccgttgggcgcgcttttaattgccgtgttcgtaccgctgaaaattccgaaacagatgctgtttgacgaactgaaaagcggttccggtataaaacgaaaatggtttgcagtctggctcctattaatccgttatgtggctcctgtagccattattatcgtttttctgcacgtgcttggtattttttagaccaaaagaagcaggcccccgttcaagacgggggccttttttaataaagcggccacatcacgcggtgcgcttgctcgaaccgtttctccgcctcccgccaatcaacgacattccaccattgatccacgtaagccgcgcggtcgtttttatattgtaaataataggcgtgttcccatacatccagcggaagcaaaggaatgacgtcccattggctgtagagctgatgcttctcagcggccaaaatctccagccgcccggagcgcggcgcccagacaaggatagcccagccgactccttcgactttttttgctgcttgagaaaattgctctttaaaagcggaatagcttccgaatgacacatcaatcatttgaaagagcgcacccgtcggccgtctttttccgtttggattcatggaaaaccaaaaaatactgtgcaaataatggccggcaccgtgaaacgccaattgccgctcccaatgcgccactaagtcgtactgtttcgtttgtctcgcttttttgagctccagttctgctttattcagaccgtcaacatagctctgatggtgtttagtatggtggagtttcataatctctcttgaaatatacggttccagtgcggaataactgtatggcagtttagggaggacatgcttgccgatcggcacataggctctgcgctcatccggctcttccggttcggtaatgtcccggtaaagtgctgatgcctgttcgtaccattccgcctccgttaatccatcatcctgaagggtgtgaaaaatccggtcgatttgtgccgcgaagcgatcgaaccgaccttgctgtatgacttgttccttcaaggtttcacaccaattcagcatttcggtttgataagcgtgccgtttcatttttcttcctccttttcactcactttcataaaagtgctgagcgcaagcaaagaaaacacatacgggtagctgtgatacctgatgtaaaactgtttcggcaggccgattccggtcggatagctgaaagcgtctccttcgtaatgccggttttcaataagaaaagatatgccttttgtgacggcttgatgatgaggtttttcgtattgcagcaaagcttcggccgcccaagccgtctgtacaagcgtcccgtaagaaagcggaacataggttttgacttctgcgcttttacaggattctccccagcttccgtcctcgttttgaatggacttcagccagcggatcgcttttttcacggccgggtggttttggctcacgccgcaagccttcatccctgtcagcgctgcccatgtgccgtaaatatagcagacaccccatctgccgtaccacgatccgtcctcttcttgatggcggatcagccattggacggccttttcaatctgagggtgatcaggagaaagccccgcttctcctaaacagtgcagcacccgtccggttaagtcgcttgttgaaggatcgatggcagcttcctcagccgattccagcggcagcaggcggaccagcggatgattgacatttttctcaaaagcagagaagccgccgtcactgttttgcatggacaaaagccagctcagtccgcgttcccatgaggcgggataacgttttcgcgggatggctttgagcactgcggctgtgtcatcacaatcaggattatttgtattaatgtttgaaaaaccccatcctcccggttcagcatgcgggttgtgaacggcccaatcagcgactttcgtctgctgccgttcacgcagaaaccgggcggctccggttatcatttgatcgttatctgagatgccgcttttcataagcgcatagctgagaagcgccgtatcccaaacggtcgacgttgaattttccaggtacggtatatcgctgcaagacgtgagcaaagctttcgtgccggcaagcgcttttctgataacgggggagtggcgcgatacaccgagagcgagcaggccgtacaccataaaaatagtggcactcgcatagctgtataatgtgccgtcttcttcaatccggtcaagcatatacgttttggccgtacgcagaccgagctggtgaaaagcggcaggaatctgcaaaagccgcttccagtgcgcgaaaagagaagagaggtctctgttctcatcatgatcggaacgaagccatgtaaacggatttttagtcatatgccgatctaaatgcgcgagagacggaacattgggatttttcagcgaaaatcttttgttaagcgtcacggccatcggtacgaaatgaatacgagcgtatgtactgaactggtaaaaatgcagcgggaaggatgggggaatgactaagaaagataatggcagatgcagcgcgggccatgggtaaaggccgtttgccgcaagcatccactttgtcatgaagtgtacgttgcgcaagccgccatttgagatgataaagcgttcagcctgaatcatatgcgcctcagaacggctatataaaccggaagccagcaagccggcatagccctgtacagtagcggtcacatttcctttccggtcatcaggatagttggcaaaagttccgtccgggcgctgtttagcgcgaatgccttctgcaagctcagcgatcagttctttatcattgtctccaagagaagtgagaaggaggatcagaaaggcgtttgtcaaaatcggaccttcaaaacaaaatgaccatgagccgtccgcattttgcgtttctcttaatagggagatggttttcttttggcggcttctgacgttttcatgaattgtgctcacactcgctcaactccttcagaagcatatatattcatatgtaaaaggcggcatgacaaaagaaagaaactgctgacaggcagcagtttcttgtttgatttaatcttccaggttgatccagacgcttttcacttctgtataattattcagcgcgtaagagcccatttcccgcccgaggccggattgcttatagccgccgaaaggagatgccgcatcgaaaacattgtagcagttgacccaaacggtgccggcttggagacggtcagcaatgtaatgagcgtttttcacattttcagtccaaagtccggctgcaagaccgtattccgagcggttcgcccgctcaatgacttcatcaaccgtatcatacggaatggcggctaagaccgggccgaaaatttcttcttttgcgatggtcatgctgtcatccacatccgcaaatacagtcggggagacaaaatacccttcttcaaacgggcagctgccgcccgcgacagctttggctccttccgcttttcctttttcaatatatgaaagcacgcgctcatgctgttcctggctgacgagcgggccgatttgtgtatcttggtgaaggccggcgccttgctgaagcgatttcgcatatgaaaccatttcgctgacgacctcatcatatttgtctttgtgaatgaagacacgggagcctgcgcagcatacctgtccctgattaaacatgaccccgtttaaagcgccgggaatggctttcttcaaattggcatcaggcaaaatgatgttaggtgactttccgccaagctccagtgtcacgcgtttaattttttttgcggctttttccatgatttttttgccgatttctgtagaaccggtaaaagcgagtttatcgacatcgtcatggttggtcagcgcttccccggccgtctcgccgaaccctgggacaatattgatgacgccgtcagggaagcccgcctgatctattaattccgctaaatagagggcggtcagcggtgtctgctccgccggtttcaaaacgattgtgcagcctgtggcaagggcggcgcccattttccacatcgccataaggagcggaaagttccaagggatgatctgccccacgacgccgacaggctcatggcgggtgtaattaaaatatgagccggcgaccggaatcgtttgtccggttatctttgtagaccacccggcataataacgcatatgctcaattgcgagcgggatatccccattcgtcgtttcattaatcggttttccgttatcaagtgtttcaagctgcgcgagttccgttttgtgctcttccattaaatcggcaagcttatacatcagcctgcttctggaagcggccggcatagtgcgccattcgccgtgatcaaaggctttgcgtgccgctttcactgcactgtcaatgtcttctgtctgtgcctcgtaaagcgtcatcagcgtttctccggttgccggattcggtgtgacaaatgttgatcctgaagcgctcggaacaaattttccgtcaatataaagtttcttcgtaccctgtaaaaatgtttccagcctttttgtgatctgcatcgttaaagaactcattcgtaacaaacctcccgaaattttttatggtctgttttgagcatcttgatgtccgcgcaaagtaagcgcatacagtcattctataataacacccccggtaaaatcaatcgataaccgttattgcaattcacaagaaaaaacggctacaataagcttatcgattaagaaaaggagttttataaatgattcataataattggcagacaaaagaaagcgtcaaaaaggtcaaatgcgtacatacagatgcgaaaaaatacattgtcaaaaatgtgctgacgccgggtaaagagtatgaagtcaaaaatgaaacagaagaattcatttttgttgcagacaatacaaacaaagtcggaggcttctacaaagagtattttgaagaagtttaaggctgaatgaattcattttgcctgagccatactaaaaaagactacatataaagggtggctgcaaaatgaaaaaaacagagcaagacaaacaaaataaaacatcagatcagcttcagcaagtgcaacctgaagaaggcaccgacacgacgatggaacaaatttcagatacctataaagaaggaacaattgaagatacggatcgttgatgttttgttgaaaccgcggcattggagaagccgcggttttttatggcgaaaataaaaaactgacttttcgaaaaaaataccgttttcttgaaaccttttcttccgctgaaccgtattacttcataactgcggcacctttcgcgaagggcttttttgatgaacgttctaaaaatgtaatctgttcgtaatggtttaaatgccgtctatgtcgtattcttatatagggataaagaacttattttttatgattgtaataaaacaatagtatagaagcagaaagtggggttcttcattgggaattttttctgtcagcagatcaaccgacacaaaaaagctggaggctttgctcgttgagggagaacggatcgaaacgatttataaactgcgggttgaccaaatatgctttacgaataaacgagtgattttctttgataataaaatgttctccaaaaagaaagtgcgcgtatttcttccatataaaacaattgaaagcttcgccattcaagaagcggggatgtttgatcccgataccgggcttgtattaatgacaaggggaaaaactttcgaattggaatttgcaaaagaaacggacttgactgaggttcaagccatcttaacaaaatacttatgcagttaaatatcacataaaagccatccgaatgcatgcggatggcctttttattatataatgcttgtttttccggagttcgaatcaatgagatccgggtcagcgatagaactgatggggatataaatcggcgccaaatcaccattttcttcaccgaatccgtagttgatcttattggataaaaaataatcgatttgctgatacgggccgatcgtaatggaagaaccgcggtcgaccgcatttactttaaagcctcctacatttaccaaaaccggcgaaaacatcataatgggcctccttttccggcagggattttgtcgcatgcagactcaaaggttgatggagaatcaatttgatcccggtcatccactttgccgttcgtgccgatgaagccgcttgcatctccgaagttctgtccgtatccctgattctttttatcagaattctgccattccgccagtaaattttgtccgacattcaccgctgaagcattttcaaaggaattaattttcaacatgaaaatattaatattgatatatggagttggttgaaccacaggcaaacctcctttaatacaggtgtatgccggctgttatgaccgtatgcttagacagggggcgataaaaatggatttcgataagatgaagcaatggatggaaatggcgcaaaacatgtccggcggcgacttttggaaaaacgtttttgatgatgaacaactgaaatcatttcaaaacggccattctcattttccctttcaacagggagatgggcaaatgagaagaaatgaggatgcttttcctcttatagatattgtggaaacccatgatgagctccaatttttgctgtatctgcccggctaccggaaacaagatgttcagctgttgtcctacggagaatatattgtcgtaaaaggcacgagaaaatcctttttcaatgaacaggattttaaacagaagaccggaaaatacggcgattttgaaaaaaaactcgatcttccgcattccgctcaaggtacgaagggaatgcaggcggtattcaaagacgggattttatatatatcgattgctaaacatctgggggatgcaagccagatcattatcgaaggctgatcttgttcgctgtgccatctatcagatctgaatcatcgatactcatgatagggatggcgacaacggtgcaatcaccgttttgttcaccgtacccttcatttcttttattggctgctgtgtttctcaccataacggaagagccggtgttaaaagccgctccgccgctgattccgttcatttttatatactcaaagttgataacggatggaaaaaacatcatgattcgcctcctttttgtatatcatgtttatatattcgcaatacgggacgcatagaactttccaagagtgacggggaaagaagtgattttctttgaaaaaaataatgaaagagattttcaaaaaagtgtgtgaagaagaattagaccggcttaagaaagtggaacaacagcttgatgagcttcaggataagtgtcattttgagccgcaaacggttgaaggggaaaaaacatatgtccatattgagcacgtcaaagtggacaagattgaatacaatattgattttgaacagctgagtatagaagagctgagcggtatgctgaatatcggcgccacttaccatacaccggcgcacaggctcaaacaagcctgcgctgaagaaagtcgggacaacccgcaaaatgatgctgcgaaagaaaaaagacagacaaagcagcagacacccaatgtcaccatcagggggagaaagcattgaccccattgtttcatcctcctttttcgagggtatgtattaacagatgcagcgaagaatacagacgaaaaaggagatgatgaatatggcattatcaaaagaacagcaggacagcctttatcataaattaatcgatttaaaggaaagtcttcagggagaatccaaagaaaatcattcaatgagcgaagacacaggagaactgtcgaacggagtagataatcacttagctgatcacggaagcatttatttggacagggtcacgaatcagacgctggacggtgtcgatcagaatcttttagatgaggtgaacgccgcgcttgaacgaatggataaaggaacatacgggatttgcgagaaaacgggaaaagaaattccttatgaaagacttgaagccgtaccgtacgccagaatgaccgtcgaagcgcagcgagaaacagaaggggatgtgaaaacagacgctccgtcatatgaaagggaatttcacgagcaggtgaaagacctctcaaataaagaaaccgttgatcaaaaaagctcacaaacttacgaaatcctggatcgcgagcaggattcacaataatagcagcaggtacattcatatgtacctgtttttttattccataaaaaatctcagaatcgaaataaaatcattgactttatataaaaagaaagtaacatactatttgtaagtaaatattaaaagattaccgggaggaatttagaatgtctcaagtattatttgtaaaatcaagcgaccgtacggctgaagaaggcgtatccgtaaaattatacgaagcgtttctggctgcttataaagaaaacaatccgaatgatgaagtgatcgaacttgatcttcataaagaaaaccttccttacctcggaagagatatgattaacggaacattcaaagcttctaaaggaattgaaatgacagacgaagagaaaaaacaagcgtcaactgctgacatttacttaaatcaatttgttaaagctgacaaagtcgtgtttgcattcccgctttggaacttcacagtgcctgctgtgcttcatacttatgttgattacctgtctcgcgcaggggttactttcacatacacgcctgaaggccctaaaggtctgatgggagataaaaaagtagcgctcttaaacgcacgcggcggcgtatattctgaaggaccgatggcatctcttgaaatgtcattaaacttcatgaaaaccgttcttggtttctggggtgtccaagatcttcacactgttgtcgttgaaggtcataatgctgcaccggataacgctcaagcgatcattgaaaaaggactgcaagaagcgaaagatctggctgcaaaattctaattgccataactcttgcgcccctacagggtgtgagagttttttctattatagaagaaactggcggcagctttcgattcaatcttatattgatatattgatattttgtcgaaaaaacaatttttatgtagaataaagcatttttcacaaagaaaaaaggttttctgtaaaagaattaaccctcttgccaaaatacgactgatggtgtaggatataagagaagctacattgttcgtattgttaattaagttttaacctttaagctgtaatagggagttttatatcgaagccggaatgtcatgcctccattgcagaggacgacaggaacgcttctgcaaacacccactttgaggagtggtggtttaaaactttcttacttgcgtacggcatacgtagcgaaagccatttcccttgcggagatggctttttattttgaattgcccttgagcagcgtactttatcagtatgataaaatgaaagaatcaaagacaaagtgaggttttacaacatatgctggataaagcccaatcccttctggcgcattattttggctacgacagtcttcgcgcgggccaaaagcaggcgatacaatcagttgcagaggagagaaaaaacacggtctgcattatgccgacggggggcggaaaatcaatctgctatcagattcccgcactgctgtttgaaggaaccacaatcgttatttcccctcttatttccttaatgaaagatcaagtcgacgcgcttgaagaagcgggtatcgcggcagcttatattaacagcacccagacaagccgtgacattcatgagcgcctgaccggtttgaaacaaggggcttaccggctcttttacatcacaccggagcgtttgacttcttctgaattcattcacatcctgcagaatattacggttcctcttgtcgcaattgacgaagctcactgtatatcgcaatggggacatgatttcaggccgagttaccggaatatcgaaatcctttttaatgaattaaaagaaccgcccgtcatcatcgccttaacggcgacggctacgcctgaggttcatgatgacatctgcaagcagcttcatattaagaaagaacaaactgtatataccggttttgccagagagaatttaacgtttaaagtagtaaagggcgaaaacaaagaccggtttatcgagcggtacctcgaaaaaaataaacacgaagccggcattatatatacagcgacaagaaaagaaaccgaccgtttatatgagaaattaaaacgcagcggcatcaatgccggccgttatcacggcggattggcggatgatgacagaaaagaccagcaggagcgttttcttaacgatcagatacaagtgatggtagctacgtccgctttcggaatgggaatcgataagagcaacatcaggtttgttttacacgcgcagattccgaaagatatggagagctattaccaggaagccggacgggccgggcgcgacggtcttaacagcgagtgtgtgctcttattttcgccgcaggatattatggtgcagcgttttttaatagaccaatcggccgccggagaagaaaaacaaaagcaggatctcaaaaaactgagacagatggtggattactgtcatacggaagattgcctgcagcggtttattctgaagtatttcggcgagaatgaggcggaagcttgcgaagcgtgcggcaattgcactgatacaaggaccgcccatgacgttacaaaagaagcgcagatggtattgtcatgcatcatcagaatgaatgagcgcttcggaaaaacgatggtggcgcaggtgcttagcgggtctaaaaataaaaaagtgctggaaaacggcttcagcagcctgtccacttacggcattatgaagcatcaatccgcagcggaaatcagtgattttatcgaatttcttatttcagatgaatatatcagaatggcggacggcacatttcccacgcttatggtcacccaaaaaggcagggacgttctgcttggaaaaagcgcagtcgcgagaaaagaagccttacaggccgccgccgtcaccgaaaatgatgaattatttgagcttctccggcgtctccgcaaagagattgcagctgaacagggtgtgcctccatttgtcgtgttctcagatcagacgttaaaagaaatgtcggcgaaacttccgaaaacagatcaggatcttctttccgtaaaaggggtcggggaacaaaaaagattgaaatacggagcggtttttttagaagaaatccgaaattatgtaagagaaacagagtgaaaaaaagtttttttagaaatttgcacattgtgtttttcatgggcgccggaaaaatcagaagcttgaaaacccttgctgtatcaaggtttcagcaagacttaccaagcgagagaaatgtttcatgtaaaggaactgtaatctaattcaaatcgttttgttattgaactgacattttcatatgttacgatatcacctgttagccgccaataaaaagctaacaagggaggatttacttatgaagaagacgattatgtcctttgtcgcagttgcagcaatttcaacaactgcatttggagctcacgcttctgctaaagaaatcacggtgcaaaagggtgacacgctctgggggatctcgcaaaaaaacggagtgaacctaaaggacttaaaagaatggaatcagttatcttctgatttaatcattgaaggagagaaactgactatttcttcagtagaaacaaccacatctgggcagtacacagtgaagcagggcgacagcctctggaaaattgctcagaaattcggaacatcagtcggcaatctgaaaagcttgaataacttgcaatcagatataatttacgcaggcacaacgttaaatgtgaaaggtcaggctcaggctcaggctgcacagccggctcaagaagccagccagccgcaaactgaacaaaaaccagctgctgagacagaacagccgaaacaagaagctgtcaaaaacgagcagcctaaacaagaacctgttcaagaacaacaacaacctaaacaagaagcgaaggctgtcgaagcaaaacagcagcctgttcaatcaaatacaaaccaacaagagcctaaaaagcagatgacaatgactgcaactgcttactctgctaacgacggcggcatttccggtgtaacggcaaccggtgttgacttaaacaaaaaccctgatgcaaaagtcatcgcggtagaccctagtgtcattccgcttggctctaaggtttatgttgaaggttacggagtggcaacagcagcagatacaggcggcgcaattaaaggaaataaaattgacgtatttgttgcaaagaaaagtgacgctaacaactggggcgtcagaacagtaaatgttaaagtattagactagtttcatatagagatgaagaacacaaggcgaaatgctttgtgttctttttttcttcccttttttgactgtatataatcgttatatgcggaaaaagaaaaagcgtttctctaatataataaggaatggatgtgaaaaaagaatcggaagggatgaatctgatggagccggaatgtatatgtttatggaataccttcacagaatcaccggtgtttcaagcaggtatatgcaccgctttcgccattgtgctcgttatcggactgtctatgcctgctgtcaggctgtttcaggcgcttgacagagggagaggaaggccagccgttattgaaaaggtgagacgtactggcgtgatgaagaatggcaggcacgagcttgtacttattttaaacgtaaaaaaccaagacggaacgcatgataaacgtgaactgacacacgccgtatataatgaagagatcagccgtttttatgaaggagcttccgtatgggtgagggcagcggctggcggacgaattatgatcgctcctcgcacgccgcggcataaggcgtcaaaataaaaagacggggcggttttcccgtctttatgtattaatgccgatcgatccatatccgtccgccttctgagccggcttctatcctgcatgctcctccgatcgggaatgtcatcaaaggggaggtatggccgaaatcagcatttgcgataacaggcatggatgacagttcttcttttgtacggatgacggcacgcagagcctcctcagacacatttgaagcatgctggaaacgtccgatgacaattcccttcacggctgaaaaagcgggaagatggatgagtgactgcaaatcccggtcaaacatatgaatgtccgacatatgatcatcttctataaacagaatcacttgttccatctccggaaagtattcggtgccctgcagaagattcagcgtgcatagatttcctccgatcagtgttccttccgcatatccgggctgaataacgagcggtcccggattccgataaaaacgtctgtcctcctggttcaaataccatttatcatcactccactcggatgaaggttttacctcatacgggttgtcagaagcacagcaggccaagaaagagtcaatcgtatagtccagcccttttttcatggcaaatgaagaaaaatggggaccggaatatgtaataaggccggttttttgatatatggcatggccgagagcggtaatatctgaatagccgcaaaggattttcggatgccgcttgatgttttcataatcaacgtagcggagcagctgatttgattggaacccgccgagtgtcgtcaaaatcgctttgatgtcaggatcagcgaaagcttcgtgcagatcccgtacacgcgattcaatcgatgatgaatgaaattcatttatttctttcgcattctctgaaaaagagacacaaaagcccagctcctccaattttgtcttcgcggcatttatattttcatctgacatagcggacatgcttgtggccggagacacaatacggatgccgtcgccttttttcaatttttccggatacaaaaaaaaccctccttaaatggtttaatctattacaccatattaacgagggtttatctatcattttttacaggtcgacccatttaatgccgcctgattgcgtatcattgtcaatccagacatcaaattgatgcttttcataaaaatgaacgagccggtcgacatgatcccaatcacgcttagcgatgtcgcccgtcactttcgggatattctgctctctggcgatatgttttaaaaatttcatgcagatcgagccgtagccgtggttcggcgggcctttaatatccccgatatgaatggcattgtcataataagaagcgatcagtgaaaaacagcctcttccccggtaggctgattcacaatcagtcagcataatcttacatgtttggccatcatcaatcgaggaaacaatgatccaatcgtcattgttcgattgatcaataccaagcactcgcgcgtcttttgatacatctatcagattttcccgcattctgaaaatctgaaattcaagtttatgaagctctttttccagctctttctgatctctttcttctgcagtaaacaaaatcatactcctttcacagcgtaaaagtcttagtcaaacacaagtatccattgtagtaaatgatgtcttggtttgtaaatgggttttgcaaaaacttttttagaaaagtctgccgtttatatgtggattgacgtttttaaggcggtggggatagggaaaggaacagtgagcagcggaaaaaggaggaatctataatggcaattgactcactcatcggcaaattgaagtacgtaatgacggaatctcctgataaaatgctttccttatatgtaaatacggatatgagaaatccggatcagcaggggggagagtggaaaatcgccttgaaaaccggttttcggagattaaaagagtatctgtctgtaagtgatccggaagaagaaaaatctctcgtccgcatcatgcaacgtgtctatcaatatatcgatgggcttggtaaagagatgccgcgaagcctcgtattttttgcatcgggggaaggcggtgtctgggagacgattgaattgcaggtgcctgtcgaaacacgattttattgggaagaaacggctgtccttgatcaattagaacttctccgtgaacaatttccaagcacggcttttattctcacccagcagaatgaagtgaagatcatagaaaccgtactcggaaaaattgaaggggtggagcattatcaatacgacgtcatcaatgaatcgtggaaaccgcaggatgtaagcggaagctccgcatcaatggacgaagacgccgccaaagcccatgtcgaagaaaaccaaaacaggctgtataaacgattggcttcaaaccttgatcaaaaggccgcttcacaccaatgggagcgtctcgtaatcgcaggggacaaagaaacagccgatattctcgatcagcatatgaataaaccgatagatcggatcattccaaaaaatctgttgaatgaaaacgaacataaagtgatagaagaactgttgaaggaagcataatatgacgaaaggccgggtctcaaacacccggtctttttagggcttaagtttgtctaatttctgacgaagcggacgaaaccgttgacatcaaagctgaattctcataccatttggatagtcagtaaaattgagagaggtcataagatgaatcagacagaaaacaaacctaaaagttataccggtatcgtgctgacattgaccgttttgatcaacgggttaattgcggtgctgttttttatgccgaaatcgggacaggtcagcattgccaatattcatattctgccgatgttaaatgctatttttaacagctttacttttatctttttgctggcagcgctctttatgattaagcaaaaaaatattcaagcgcataaacgctttattttggcggcgtttacgacgactctgctgtttttgatctgctatgtcgtgtaccactcgatagctgagaatactttattcggcggccacggcatcattcgggggatttatttctttattttgattacgcacatctgtctttccgccgttatcgtgccgcttgcgctgtttacgctgatcagaggattcagcatgcaggtggagcgccacaaaaaaatcgcgagatggacgatgccgctctggctgtatgtcagtctgacgggtgtcattgtatacttaatgatctcaccgtattattaaaaaaagccgtgctctgcgcggcttttttctattgatggaaaaaggcgcctcatcagggcgccttttactcttcaagcgtttcaagtgttgttacatttaaggattgttcaacggtttttgtttttgcttttactttttctgcgtacgtgtaatcaccatagcagtagggataacggaaattgtctttgttccctccgcaagtgtaaagtttcggattctttttgacctgctgctcggagtattgttttgccagttcctcagtatgcgatcctccatgttcagccacaaaatcaatatagccggctcccatgttgtagctttgtataatcgtatccaagtctacgccttttttcttgcctgtttggtacatgagagtgaattgtttgattccctgtttgatactggtttgagggtttttaatctcatttcgctttaaacccagagattctgaagactgcatgggatcatttcctcttccttttgactcctgatatatcatgccgagtacaagcgatgtatatttggtgagtcctttttcatccagctcgtcttcaacaagcggtttgtaatctgtcagccgttcaagcacgatcggtttgacatcaaacggaagacttttgagccattcattatttgaaaataacagaatgaggaagaaggaaaccatgacaaaaacacatatcatcataagacccgcggcagcgaaacagccttttttctttttctccactgtgtttcaccctcaatttcaggagcattatgactttttcattatgacacagatggatgcgcgaaaccaagcggaaacccgtatttgaaacataaatttaaaataacggttcttttgtcaggcgcaggatgtatctgcatcaattgacatttggtataattgggctacttgagaaaagaagggtgaggtatatgactgaatttcacgaatccggaaagacgaatgaccccgctgtcgatttagatgaggaaactttatttttggttgcccagacttttaaggcgctgtctgatccgaccagaatcagaattctccatttgctgtcacagggtgaacacgcggtaaatgatatcgcagaaaagctgaatttgctgcagtctaccgtttctcatcagctgcgttttcttaaaaatctacgcctcgtcaaatcacgcagagaaggaacatccatctattattctcctgaggatgaacatgtgttagatgtgcttcagcaaatgattcaccatacgcggcacgattaaaaaacatccctgctttttagacagggatgtcagccgtactgactgttattggtttggtctctgctcgtttttaaaacataaaaagagaagccgctgtaataaactgcgatgaaataaaagatactgatggtcagcggatcggccccgaccgtttggctgtatgcctccggatgggtaaagtccgctgtgacccggtaaatttcaataacgcgataaacaaatctcgataggaaaaacgttaatagaataagttcaatccacagatgagtgcgaaaatacatttttccgcggcgttcttcaaaagaaatattccgtttggcaaacaggaccagaagccagccgcaaaaagtgccgaatataagatggccgtataaagccgggtgtgtgatgctgaaaaacgccagagctgcggccagcaatgaaaacaaaatcattcttgtataaagccagcggggtttcaaaggctgaaagccgacggaccgtttcacctttttatacagaaaaaaggcaatcattaagacagggcagatgctttgaagtgtgatatgcatggtgtgaaactccccctccgttgagtagtgtatgcttatccggctggttttagtagtctgatttattcgcaggctgaaagcatcttttatcacagtatgcgcgtttcttttttttgcataagagaagcgcccgcgcctttttcaggatttaaacagaaaactcttgataaactaacggtattagttataataaaactaacgatattagttttagggggatgttgatgagaatcttacaatacggaagggtttggcagctgactttttttccagcgcttttcccggtgaattgttatttggtcgaagaagaagtaggagtaaccctgattgacgccggactgcctaacagtcataaaggaatcaaacaagcattgcggcagcttgggaagccgctgaatgacatattactcacccacgcgcacggggatcacatcggttcgcttgactcattagctgcggaatttccggatgcctccgtctgtatttctgagcgggattctttcttgctgaaaggtgacacttcattatttgagcatgaagcacaaacgccgataaaggggggagtgccgaaaaatgttcagaccgaacctgatcgcctgctgaaaggcggcgagcggatcggatctttacttgtcattcccgctcccggtcatacgccgggaagcctcgcttttaaagatatgagaaatgatatgctgatcgtcggagatgcctttcaagtacggggcggccttgctgtttcagggaagctgaaatggaaatttccgtttccggcttttgctacgtggaataaagaagaagctgtaaaaacagcaagaacgcttatcgctcatcaaccaagcagtctggccgccggacatggaaatgttctctgcaatcccgttgaaatgatggctgaggctgctgaggaagctgaacgaagcctgccgggaggccgatcataatgtcaccgagagtcggaatgagccttgacatgatattgagagccgcagcaggcatcgctgacaaaaaagggctgaacgaagtgacgcttgcggccgttgcaaagtccttaaacgtaaaaccgccttccctttacaattttgtcaatggccttcaaggaattaaaacagagctggctgtctccggtttaactatgttatttgaaaaaatggcggcctctgcagaaggactgacgggtgaaacggctttgctcgctcttgccgatgcctatatcaatttcgccgaagccaatcccggattatatgacgcaacatttcaaaagataaaagacggccggattgagaatctgtcaagcctgcttgtagagcttgttgtcaggcagctgacagctaacggttatgcacagtctgacactgcgattcatgctgcgagaggactgaggagccttcttcacggctttgccgtgttgagaaaacagagtgcatttgaattaaccgaatcaattaaggaaagccggaagtttgcagttgttgctttcctaagaggtttacagggtaggtaacaataatattattatgtaaactaaataaaaaaacgcatcagtaaaaggagggacaaatggattcattacaacatatcatttgtgagcggcgcacctattcacatatttttgattctcatgcacacacatactgccaaatgctctttccgctcgaaggacagctggacttggagacagaaagacgtgaaatcagattaaaacctgatcaaatgctgtatattccgcccgggcatgaacatcggttccgttctttggagcgaaacgaatgtctcgttctcgacataccggcatattttttcaaaggttcatttgatcccggcgttctgaataagcttgattctttttggacatcgattcggtttctgctgacagaagagactaagcagcagtcggctcattcattgagtctgcttgcagaatatattgctgaaaagatacaagaaaaccgtacgaatgattcaattgcgtatatccgccgaaatctctcaaagactttttcaattaaagagcttgccgcaatggaacattaccacccggcgtattattccgactggtttaaaaagcagacagggaaaagcccgcaagcttatattgctgagctccgtatgaagaaagcggaacaaatgcttattgaaacaaaatgccggctgacagacatcagtcaggaggtcggctttcaaaatttgtcttcctttaccagatggtttgtcagacataagggaataacgccgcgcgtcttccgaaacacctttcaatctgataaataatcctgaaaatcagttaaataaactgcgtctttttttggtatcatgattgtaaaaaaggagtttttgatatggcagtcatcgaagattttatcaagctcgatctcagaataggaacggtcgtaaaagcggaagtattcccggaagcaaaggtgccggccattaagatgacaatagatttcggcgaagagatcggcatgaaacaatcaagcgcccagattacaaaacggtacgaaccgggtgatctgacaggcaggcaggttaccgctattgtcaactttccgccgcggcggatcgccggatttaagtcagaagttctcgttcttggcggcatcccggaaaaaggagatgttgtcctgcttacgccagagcagtcagtaccgaacggaacgaaaatcggataataaaaaaagacgtttgcagaagcaaacgtcttttgcgtattgaggcgatacaccacacgccacattcgtgtgtgccgcaagggcatgtgcatcggcttacacaattcagctcatcgctatatgaatatagcatggccggtgtggaaatgcaagagattttttaatatatgttatatctggctttgttttgccgatccccgattccttcgtgtaaggttcgtttgaaattttatgatcttgaataaagcagttcgacaaatgcaagagggaatttgagcaagttgtgaccgaagtgtgacctggaattaaaatccgggtctttttgtgtaaaagatgcatgcgaagagaccatataggcattaaatgttattactgatgtcttcatttatcttttggctaagtttctgaaccttctctttaacatttgaaacagctcttttttgaatttcatcaaagttctcctgaatatagtccatgacacttcttattataacttcactttcaaaattgaatatctcatttatttctgactgttcttcatctgttaggtgatggtattgaagttgtttagcatttacttcagcagctgcatcaatcctaacttagttgttctggctgtacaatttcatattcaccttctgcatacttttgctccgcataatggtctccccattgacagagctcctgcaagataggtttaagagattctccaagttcagtggatgaatattcaaccttcggcggtacttggttatacatctttctgctcacaagtccactggcttcaagctctctaagtgtttgaatcagcattttctgagttatatttgggataatgcgctttaattcactcgttctcttcggtccattcattaaaaagtataatacaaggcctttccattttccgccaatcacttcctttgtcacttcaaacccacagctaaattttttcatgtctaaagctctccattccacatttattactttttagttactatatcacaaaaaagtgggtacttccgataatgtgcttactgaaggatactattacttgtaagttgttcttcaagtacttaaaggtactagacataaaataatattaattctaaaggagtgttaagtatgggtgaatttgaaggtaaagtagcgcttgtaacgggtggaacaagtgggattggtcttgctgcagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacatgataaagcaggaaaaaggtaagttggacatcctttttgctaatgcaggcatcggcagctttcttccattaggtgaaattactgaagagcaggttgatagaacgttcggcattaacgtgaaaggaaccatttttactgttcaaaaagcgttatcactattcccggacaaagtaggttctattattgtaacgggctccaccgctggatcaattggcaacccagcatttagtgtatatggagcatctaaagcagcattaagagcactggttcgcaactggattcttgacctaaaaggtactgaaatccgtgtaaatgtggtaagtccaggagtgattcttacacctgcatacgatgagctttttggtgatgcacttgaaggagcgatggaaaatgccagaaatactgttccagctggaaaagttgggacacctgaagaagtagctaacgctgtatctttccttgcttcagacgaaagcagttacttgacgggtattgaattgttcgtagatggcgggctagcacaggtataatttcactgcgcagaggttacaaatcttccccaaaaaaggttaatggggatttacttgaagaagccgtataaaaaagtcgttttccttaaaggacagggaattcgacttttttatgtttgaatttgattaacgttgtaaattcgcattttcctggggctgccactaaatgacctgtaaaaaagattactttgtgaataaatgtacttaaagtaacggaaaggagaatgtccagttgttatttggagtgaattcggtggctataaagaacttaattctgcccattttataaagttcttttatgaaagacttcatgaaatgaaagaaaatcgggaagaagatgaagactaagacgattaataaaagaaagctctcttttagagagcttttttcagattttcaatttttaacaggctttataatgagcaaacaggcattactcaaaatactcgccgcgcctatccaaagcagccattgtgttgcggtcagccatgaggcagttaggataaagagtccaatggcaattgatatataattgccggctcggtccagtttacgattgcaatgaagtttatatttagcatgagaaataaattgatcaattttatctttcagctcatagcatttttccttcatcttatcctcagtttcttttacttttcgataaagcatattattcatcgtttgcactcccatatcgccgttttgaaaattcagccatgattttttcttcatagtcatctgagatggattgtgcctggtcttcaactttcaaatgtgctttttcttcaaaaccgtcctgttcttcaccatcaaaacgataaagtttttgcaatagcctccagaatgtttcaacttcttcagttgtgaactcatgaaacatatccgctaaaaaataggtggatctttctgaacaggaaattaacgctttttttccttcaggggtaatctcaatattgattgcacgtttatccagtttgcttggcacagtgtgaacatatccttttttcgagagacttgaaattaatttgttagcggtttgttttgttgtgcccagctttttagcgatattcataagtgtggtatcttccgtcggtaaatgggcaatagcaataagagtcatgtgctgtcgggaagtcaacatttctaagtattcgtccccccgagtctgcaccttattgacaaccgaaaataatgatgcgtaactttgttgcataaaatgcagttccttcattagtaatttaatatccataagttatctcccatctaaattgtcaccatgttgacaattacaatatacatcacgaagggaaataagtcaacatggtgactaatagggcgggtacggctgttttcaaaaatgccacagacagtcggagtgtttacaaaaggggaaataagtataataaatgcgaaaagggcattaatccaaagtgggaaggtgtttgacattcagaaagtgaactggtcagaacggtatgaatggttcaataaacaagatgaaaaagatgggcgtttaatggcgttccttcgtcatgagcttacatatgaggaagtcatacggttatataagaaagggttttatttgaaatcaaaagaaggggatgtttcgttacgtaagaacgatatctgtcgtatgtttggggttgaagagaggcagtggggcaaatcttaatgaacgggaagagaaaaactcttcccgcttttcatagcagctgttattctttttccagcatggaagtcagccattctcttaatgccggtttctgcacataccgctttccgtttctcgtgatatgcggaatgtcagatattcatgaggatcaggtgagttaaagttttcaatccgtctccgatgaaatatccggctaaagcgattccaatgccggtaatatatccaaacctccaataaacgttatcattttttatacggtgaagccggccggaggattcagccttcagcaaaaccgccgggcgtttattgcggacggttttgattgctgagcttttccacctgcacctttccggagaagaaaacagcacctccgcccatatccgccagccgatcgggcgtgagtgaattgacgagctgttttttatcatccatatcggcccaaagaccttggctcaccgcaacgccgggaagcacctgttcgccgaccgaaacagtcaattcgcactctccgcggtgattccaaactctaacggtttctccgtcttctatgttccggtgtacagcctcttctgtatgaataaaaagttttggcgctttttccagttttacgtgtttttcgttatttgaaaatgtcgaatttaaaaaattatgattcggtcccgggacaaataaaagcggaaaatcgtcatcgctctcaagagggatgtgtgtcggcagcgccggataaccgtcctgtttcatcttttccgaatataattcaattcttccgctcggtgtcttgagctttcccggaaaaagcggttttttccgtttggctttcatgaaggaatggcttgagagcgcttcgtaatcaatatcctcgatatacggattgtcgggaaagtccagcgcctgtctgattaattcttcatcagaatcctgaagctcctgctcggtaaatcccattgctccggcaagcagacggaacacttccgtattcgatttgctgtctccgtagggttcgatcaccggtttttgcagctgaataaaatgatgccagtaagacgtgtaaaaatccgtgttttcaaaagcggatgaagcagggagcacgatatccgcatatttggcggtttccgttaaaaacagatcgtgaacgactgtaaataaatcctcccgcagcaggccttttctgactttattcgcttccggcgcaaccactgcgggattcgtaccgtaaataaacagggagcgcacgggcggttttgtttctaaaagaacgcttccgagcctgttcatattaaatgatcgcggcttccggccgtaaagcagatcaggccgctggagcgcttgtctgttatagtttaataccgcgctgttgtgcttgattgcgcctcctccggtgttgagccactgtcctgtaacagccggaaggcaggcgacggtgcggacgatcattccgccattgtcatggtgctgaatgccgtttccgatcctgataagggaaggggaggtttccccgtacattctcgcaaggcgtctgatatcgtcggctttaacgcctgtaatagcagaaaccgtttccggatcatagtgtttgacatgcgcttttaattcgtcactgccttcggtgtattctgtgagaaatgcttcatcgtgaaggttctcagcgaataagacatgcatgataccgagggcgagtgcggcatctgtgccgggacgaatgggaataaaccaatcagcaagccggccggtttggttcttatgtacatcaataacgacaatcttagccccttttttccgggctttttgagcaatcatgacttggtgcatattcgtgctgacggcattgattccccaaaaaataaagagcttagcatgtatggtctcctccggatcagtacccgctccttctcccattgtatagttatagccttcagaaccggctttgctgcagatcgtccgttcgagatgactcgctccgagacgatggaaaaaacggcggtccattccctctgccgccagttttcccatattgccgtaaaagctgtacggaagaatgctttccgctccttcttcggcaataagctctttccagcgcgaactgatcgtattgattgcttcctcccaggaaataggcgcaaacgcggcttcaccttttttaccgatcctttttaacggaacggttacgcgcttctcatcataaatacgctcagccatgtgtctgactttgttgcaaatattccctgatgtgaccgggtgatcggggtctccctgaatgttaacgatttttccgtctttttttgtcacaagcaagccgcattgatcgggacagtctagtgagcacaccgacttaaagaccccgttcggctgtgttgcagcagaattcatagcccatttctcctctttgtttatattgtaagcattataacatttcaaaatcgaacgtcaattcagaaaaaagtgttgacattacggaaagacttttctatgatgagtttattcttttaaacagcctgacaatttcatcattttattttctatccagagaggtggagggactggccctatgaatcctcggcaacatttattgtgccaattccagcaagcgtatgcttgaaagataggaaagaatggtctatacatatttgtgcgcttcaagcgtataaagacggtatatgaatctctttccttctttgaggaaagagatttttttatgaaaaaatttatgtgaaaaggatgttttgcaccatgacggttttaattaccgcgccatatcacgacgaggggctgaaggagctggctgagctgttcggccggactgtgcaccggccgtggaagaagcacggccgggcctatcgggaagatgaattgatccggatgattcaagagacaaacgcgtcggggcttataaccgaacttgatgaggtgtctcagcgtgttattgacatattgccggattccgcttttatcggtgtctgcagaggaatgccgtctaatgtggatattgcggcggcgactaaaagaaaaatccccgttttctttacaccggcccgcaatgcccaggccgttgctgaaatgtttatcgggaatgtgatttcatttttgcgtcatacgtattcttcccatcagtggctgaaggacggaaagtggaatggtgattatttgcaggcttacgtcaaattcagaggaaatgagctgacggggaaaacagtcggccttatcggtttcggagctgtcggacagagaatcgccaggctattggccgcttttgactgcaaggtgctttactatgatccatttgtccgtcatgaaaaccgggagtatgaaaaaacgacgattgaacgggtattttctgaaagtgatattgtttccgttcacttgccgcgcacagaagaaaccatcggccttatcggcgcccggcactttcaattgatgaaacaggaagctgtttttgtcaatacgtcaagagcggcggttacagacagggaagagctgctgcgggtgctgaaagaacggcggattaagggagcgatccttgacgtgttttatcacgaaccgcctgaatcttctgattatgatttgatctctttgccgaatgtgttcgcgactccccatttagcgggcgcaacatttgaagtggaagatcatcatgtgaagattttaaatgaagcgcttttcaaatggaaacaagatcaaacctattcaatacgtgaactttataacaaaagagaacttgaaacggaaggaggaggctgtaatggctgaacaaaaaggctaccttgtatttgacatcgggactgggaatgcgcgagtcgcggtcgtgactgccggcggcgaagtgaccgcgcttgaaagggaagacattgaatatgtgacggatccgctttatccggacggacgatatttctcaccggaagggttatggacgcaaatcagcgctatggcaagaaaggctattgccaagagccctcatattacattaatcggaatcacctcaacaagccagaggcagggaatcgttttgatcaataaagataaaaaggcatttctcggtctgcccaacattgataacagagggcgtgaatgggaaggcggaattgaggcagaagaagtgcatcagcaaaccggacgtcttccgagcgctttattttccgccatgaaacttgtcggattaaaagccagacagccgtctttatggaaagaagtgaagtgcatcacaagcatcagtgactgggtgacatttgagctgagcggaattttaagctatgaaccgtcacaggctgctgaaacactgctgtttgacgtaaggaaaaaggcgtggtcagagaaattatgcaacatcttcggtgtgccttctgccattcttccttcactcgtccgatctgggacggttgtcggaatgttaacgtttaagaaagcggcggtgctcggtctttctgaaagagtgcctgtgattgcaggcgggggagacacacagcttgccatcaaaagtgcagatgcaaagccgggagatatcgtcattgtatccggcacgacgacgccgattacaaagataacagcggagaccggaaccgaaagtttagagaatgcatggctgaattgccatacagaagaaggtgaatggcttcttgaaacgaatccgggtgtaacaggactcaattatcaaaaattaaaatccattttttatccgaatgaatcctacagcgtcatggaacgggaaatcgcaagtctgccgaaacatgatcatgcctgtatatctgcgttaggctcctatttatctcctgagaaaaacgcactggcaaaaggcggatttatttttgacgctccgctgtcccaaaacttaagcagagcccattttgtcaaagctgcactgctggaaatcgctttttcaatcaaatggaactatgaggcgttaacagaggcggcttccttttcacaagattatgtgaaggtgtgcggcggcggtttccaaagtgatgctttgacgcagtttcttgctaaccttcttcaaaagaaaatctataagagagaggggttcagccaggcatccgcaatgggagcggtgatgatttgcaacgaagctctcggtgtgaaagcagagctttcgacctgcacaaaggtaattgagccggaagcggatcagacggatctcttcctatatgaagaatggaaacatacccaaaaattatttactcattttcagccggcggtgaaagcctgacttggggatgagatgacaacatgaaagattgctgaggaggaacaaaaatgcttaataaaataggaattccgaaacagctcgcctggggatttttaggggtcgtgctgtttatgatgggggacggccttgaacaaggctggctcagcccgtttttagtcgaaaacggcttgacggtacagcaatcagcatccttgtttacggtttacggtatttctcttgctgtggcgtcgtggttttcaggagtctgcctcgaagccttcggcgcaaagcggacgatgtttatggggctgttgttttacgtcatcggaacagccgcgtttatcgcatacggatttgagaatcttaatttgccggtgatgtatgtcacgtattttattaaagggctgggttacccgctgtttgcctattcatttttgacatgggtgatttaccggtcgccgaaaaacaggctcagtacggcggtcggctggttctggattgcatattgctgcgggatgtttgtattcggtgcttggtattcaagctgggccatcaaatccttcggctatttgaatacgctgtggagttcaattttctgggtatgtctcggcgcgttttttgctttgattttaaatagggaccgctttgaaaagaaaaaggcagataagcgggaaaaggcgcaggaattaatgaagggaatcaccatccttgctgaaaatccgcgcgtgctctctgggggatcattcgaatcattaacagcatcggaacatacggatttccggtattcctcccgatgcatatggcgcagcacggcatttctacaaatgtatggctgcaaatttggggaacgatttttctcggaaatatcgtctttaacttaatcttcggcgcagtcggcgatgccttcggctggaaaaagactgtcatgtggttcggaggagtgggctgcggcatttttactcttttattatattatgctcctgttgtatcacatgggaatttgctgttcgtcagcattgtcggttttatatggggagggctcctcgccgggttcgttccgatcggggctatcgtgccgacggcggccggcagcaataaaggtgctgctatgtctgtgttaaatctggctgcgggcctgtcggcatttgtcggccccgcgcttgcctgggcgttcatcgggcttgtcggcgcacaaggcgttgtatggattttcgcagcgctctatttcgtaagtgcgatcttgacaaatcaaatcaaaatacctgaagagaaaacggcaaaacacaataaagcattgcctgaatacgcttcttaacagcagcgccccgaaaattcggggcgtttttttacggctgatgaagaaacccggcaaaccgctgaatttgttcacgtaacgattgtttgttttcgtgaaattgtttgaaacgatgtccgtttgctccggacggatgcgggaagccttccagaatgaccgcatggcccattctgcggttcttcttcagcgtgcggcaggctgattctgctgcttttccgagagggataagcagaatgtcttttttcatcatttctatttcatccggaaaacatgtcagcgcgtaacggctgagaagagctgatctgctgatggccggccggtgtcccgtatagtttttctgtttataaaaaacagggtgtttgataacggatgtcgtatgaagcagctccctttttgaatcaaaaaaccgggatgaatcctcaacgtgaagcgcggccggcagaccgcattcattaagcatttcgatgatgtgctgcctcatggaaccggaaagtccggccgctttttttgtctcatatgctatcacctcaagagattcgccgttttttaaaagctgtgccgctgctttgtacgcccgctgcatctgaaaaaaaccgggtgtaattccggagatgacaaccgcagcatgtgggttgatatactcattatgaggcgaataatacatatccagatctccgtccttggctaaatggaactccgaagtcagcaaatccgattttgtaaatcctcccgaagatgataatgctttaagctgctgcaaaaaatgcgcaagccgctcacgatcgcaaatcatgttatgcctccttgaatccgccagtttctcttagtgtcatcaaaaacgtcggatgacatgcaggctcataaaccgcttttaccggcgttccagagcattttcaggacgtgaggcgttcctttaacttcggctgccgtcgtttgcacggctgtttttttagtaagaaagtcttcctgcagttctttctgcttttgtgataacaaacgggtttctgttttgatttcttcaacggacgtctgcatggacgctgtcacggcgttaatcttctttatatcaggcgctgtgtttcttttaaaatgcacggcggatacggctgcataaattaaagcggcagccgcaacggcagcactgatatacaaaatgatgatcatctgcttttcactcctttttttcagttgataccctttacggatcgtgctgaatcattttatttgctaattgttttttttctgcttataatgtgaaatcgtacataaggacattcagaaagggtgaaagacatggaaagcttacaaaacaaaacggctcttatcacgggtgcgggcagaggaatcggccgcgccgccgctatcgctttagccaaagaaggagtcaatatcggtttaatcggccgtacagaagcaaatgtcgaaaaggttgcggaagaagtgaaagcccttggtgtaaaggcatcattcgctgctgccgatgtaaaaaaccaaaaagaggttgaacaagccgtctcttctattaaagaagaactcggtgaggttgacatcctgattaacaatgccggaatcagcaaattcggcggatttttggatcttacgcctcaagagtgggaagacatcattcaagttaatgtaatgggtgtataccacgtgacacgcgccgttcttcctgaaatgattgagagaaaatcaggagatatcattaatatttcttctacggcgggccaaagaggcgccgcggcgacaagtgcgtacagcgcttctaaatttgccgttctcggtctgaccgaatctctcatgcaggaagtcagaaaacacaatatccgtgtcagcgcaatgactccgagcacggttgcaagcgacatgtctattgaattaaatctgacagacggcaatccggaaaaagtcatgcagcctgaggatcttgcagaatatatggttgctcaattgaaattacacccgcgcattttcatcaaaactgccggtttgtggtcaactaatccttaatcaaaaggggacctgtctttgtgacgggtcttttttgttttcgcaacccgattaaataggcataaagatccgtttttgcagaaaaaagagtgaaaaagaaaccgatatcagctataattaaactaaataaactatgtaccaaatgttcaataagattatttttccccgcatccaaaaaacaaatcaatataaaccaaactgtccgaacaataaaagggaaaacgggatataaagagaatatttagtacatggaataatttgttagaaggaagggtgggcacatattgaaagaagaaaaaagaagttcaaccggttttttagtaaaacaaagagcctttttaaagctttacatgattacaatgacagagcaggaacggctttacggactgaagcttctcgaggtgctgcgttcggaatttaaacccatcggttttaagccgaatcataccgaggtgtaccgttcacttcacgaacttttggatgacgggattttaaagcaagtaaaagtgaaaaaagagggagccaaactccaggaagtcgttctctatcaatttaaagactatgaagctgcaaagctttacaaaaaacagctgaagacagagcttgaccgctgcaaaaagctgatagaaaaagccatttcagataatttttaaatccggccggaacgctcccggcctcccgggctcaaaaggtttgttctgtgattcattatacataataacaggctcggaacaatacatatcaataaaacctccaaacttgacatcgactcctgaagtggtaacataaaaaacgtgtgaaaaatacgaacaaaatacgaacaagggagatgttaccgatcttagatcaaaagaaagttgcttttatcggagcaggatcaatggctgaaggaatgatatcaggcatggtccgcgcaaaaaaaattcccaaccaaaacatctgcgtgacaaaccgccgcaatacagagcgactcgctgaattggaacatcaatacggaattcaaggcattgcttttgacagcatgaaaaccgaagacattgatgtctttattttagccatgaaaccgaaggatgctgaaatcgctcttgctacgctgaaacggcgtattcaacctcatcaaatcatcctgtctgttctggcaggcataacaacctcatttatacaacaatcattacatgaccgtcagccagttgtaagagtgatgccgaacacatccagcatgatcggcgaatcggcaacagctgcggctttcggagaccatgtctcttacggttcagcaaaaaccgcggtatctcttttggaatgcctcggggaagtgtacgtgatcaaggaagatcagatggacattttcaccggcatcgcaggcagcggaccggcgtacttttattatttaatggagtttattgaaaaagcaggtgaagaagccggcttagacaaacggctgtcccgcaaaatcggggcgcaaacgttattgggcgctgcaaaaatgctgatggaaacgggtgaaaaaccggatgtgcttcgggaaaacatcacctctccaaacggcacgacggaagccggcctcgatgcgctcaggtcagaaggcggcggagaagccattgccaaagccattaaacacgcgaccgaacgttctattgagatcagcaaaacaattgaaaaaacggcagcactataatcgttaaaaaacaggagtgatacagtgacgtctcggacgaagatcaaaagagtcgcggtgaaaatcggaagcagctcactgacgagcctgcacggggaaatcagcagaagaaagctggaagcattggtggatcaaatcgcacagctgaaggacagcggctatgaagtgattttaatatcttccggcgcagtggcggcaggttatcggaagctcggatttattcagaaaccggaaggcctccctgaaaaacaggcttctgcttccatcgggcagggattattaatggaggcttactcaaagctgtttttagcgcacggttatgtcgcatcacaaatattaattacaagaagcgatttttccgatgaataccgctaccataatgtgcgcaatacgatgaacgtccttttggaacggggcattattccgattattaatgaaaatgacacggtcacagtcaaccggctgaaattcggagataacgatacacttgcagcgaaggtggcaggtttaattgatgccgacatgcttgtaattttatcagacattgacggtttatatgatgataatccgcgcagcaacccgaaagcgaaaagaatcagacatgtaagtgacatcactccggaaatagaagcaagcgcgggagatgccgggagtgaaatgggaaccggcggaatgcgttcgaaactggatgcttttaagattgtgatggcctccggtattaaaggctttctcgggcaggctaacattccggacattctgcttcaagcggtagatgaggcggctgaaggaacttattttgaagcggaaggaaccctgccgttaaaccacaaagaacaatggcttgcatttaattccggccccgaaggcgaaattgtgatggaaaagaaaagcagccgcgatgtcgcaaacggaaatatggcgctgtcaccgcaggatatcgaacagattaagggcagattcagcagcggagcggttgtcaggctgcttgatcagcagggagaagagctcggactcggcatcgtcaactattcctcagcccagctgaagacatttaaagaaacgcctcacaaacagaccgatcaatcagtcattgatccggaagcgtttgtctgccacgttgaactatccattccgatcggctgagaaagatctataaaaatatgaaaaagcccgaggcttcgttttgaagctcgggtttgttttttattgatattgttcaagtttggagaaaaattgaatgacaaaatgatagaaatcatttgcagacggagccagttctcttccttttggtttaataatgcctacggtccgcttcacttgaggaaattcaatcggaattttgaccgtgaaccggggtgtggtttctgcaaaggtgctttcaggcaataaagtaactcccatccccgcggagactaatcctttaatggcatctaaatcctcgccttccgtcgatacaagcggcgcaaagccggcctgtctgcaagcgtcaatcgccatgtttcggagaataaacccttcaggaaataaaacgaattggtccccgcgcagatcaattaaatgaatatttttctgtttggcaagcggatgatgcagcggaacaagcgcgtaaatcttttccgtgaataagatattgcctgttatgtcggggaattccgtcggaacggggccgagcagcgcagcatctatatccctgtttcttaccgcttcgattaaaaacttataagaaccctggcggagcaaaaactcaacgttcgggtattcctctttaaatgccgaaatcacagtcggcaaaagctggcttgcaaggctcgtcggaaatcctattttgacggttccgcgattcggatcaagatattcatcaatttgttccttcgcataatcaattgctttcatcgccgttttaacatgttctaaaaattgtttgccgatcggcgttaatttaatatttctgccttcccgttcaaataaagtgactttcagctcttcttcaagatttgcaatctgccggctgatggcggattgtgcgacatgcagatgatcagccgcttctgacacatgttcccgttctgctacctccataaaataccgaagctggcgtaattccattgcgttcacacccatctatctcattttgagatgtatttgatctaaattatatattgtttatattgttttgaaaacttacaattaatttaaagttgtcagattttatgaccgataattaacggaaactgatcgggggagaggaattatgacttacaatcaaatgccgaaagcacaaggtctctaccgtccggaatttgagcacgatgcatgcggaatcggcttgtatgcccatttaaaagggaaaccttcacatgacattgtcaaaaaaggactgaagatgctttgccagctggatcacagaggaggacagggcagtgatccgaatacgggtgacggcgccggcctgatggttcagatccctgatgctttttttaagaaagagtgcggagaaatgaagctgccggaaaaaggccgttacggggtaggaatggtctttttctcgcaaaatgaagaggaaagaaaaaagatcgaaaaacaggtgaatgcattcattgagcaggaaggacagatcgttctcggctggagaaccgtccctgtaaatgtcggaaaaatcggaacagtggcacaaagcacttgcccgtatgtgcgtcaagtatttatcggagccgcaaacgatttgaaagacagccttgcttttgaacgcaaattgtatgttatccggaagcaggctgaaaattggggcgttcaagaacagcttgatttttacttcgcaagcctgtcaagccagactattgtttataaagggttgttaacgcctgagcaggttgacgctttttatttggatttgcaggatgaaaccttcgtatctgcattttcactcgtgcattcaagattcagcacaaatacctttcctacttgggaacgtgcccatccgaaccgctatctgattcataacggagaaatcaatacgctccggggcaacatcaattggatgagagcgagggagcagcagttcgtttcagaaagcttcggagacgatcttcacaaagtgctgccgattttaaatgctgagggcagtgactcatccattcttgataatgcgtttgaatttttcgtgatggcggggcggaaaccggcacatacggcaatgatgctgattccggaaccatggacggaaaacactcacatgtctaaagcgaaacgggctttttatgaatatcacagctctttaatggagccgtgggacgggccgaccgccatttcgtttacggacggaaaacaaatcggcgccatccttgaccgtaacggcctgcgtccggcacgttactatgtgacaaaagatgaccatattattttctcatctgaggtcggcgttattgaagtggagcagaagaacattcttcataaaaaacgtctggagcccggaaaaatgctgctcattgacttagaggaaggccggattatttcagatgaagaagtaaaaacagaaatcgccaatgaattcccgtatcaaaaatggcttgaagaagaattggttcaagtgaatcctgacccggaaatccgggaagaggaacaattcgatgatcttctcgtccgtcaaaaagcgtttggctatacgtatgaagatatccagaaatatttaattcctgttattaaagaaggcaaggacccgctcggctctatgggaaatgattcgccgctcgccgttttatccgatcgcgcccaatcactgtttcattactttaaacagctgtttgcgcaagtcacaaacccgccgattgacgcgatccgcgagcagcttgtgacctctacggtgacatggcttggggctgaaggtgatctgctgcatccgagtgaaagaaatgcacgccgcataaaattgtatactcctgtattatcaaacgaacagttttatgcgctgaaaacacttgtgcaccctgatattaagagccagaacatccgcacgctgttttccgatgacctggaaaaaggcctgaaggatttgtttcagcaagcggaaaaagcgatcaaggaaggcgtatctctgttaattttatctgacagggcaatgagtaaggaattgacgccgattccgccgcttttggccgtcagtgcgctgcatcagcatttgatccgtcaaggcctgcgaacaaaagcaagcattatcgttgaatccggggaagcgcgtgaagttcatcactttgcggctctcatcgggtatggtgccgatgctgtcaatccgtatttgacttatgctacgtataagcaggaaatcgatgaaggccggcttgatattccgtatgaagaagctgtcagcaaatacggaaagagcgtaacagaaggcgtcgtgaaagtgatgtcaaaaatggggatttcaactgtgcaaagttacaggggcgcccaaatttttgaagcggtcggcatcggtgaagacgttatcgccaaatactttaccggtactgcatctcagcttggcggaatcgatatcgagacgattgcgcaagaagcgaaacagcgccatcaagcggcgtacaaggatgattacagccaaactcttgatcctggaagtgaattccaatggcggaacgggggagagcaccacgctttcaacccgaaaaccatccatacgctgcaatgggcctgccgaaaaaatgattacagcttgtttaagcagtattctcatgcagcggatgaagaacgaatcggatttttacgcaatctgttcgccttcaaagaagaccgcaagcctttaaaattagaggaagttgaatcagctgcgtccatcgtgaaacgttttaaaacaggagcgatgtcattcggttcattaagcaaggaagcccatgaggctttagcgatagcgatgaacaggcttggcggaaaaagcaacagcggagaaggcggcgaggacccgaaacgtttcgttccggatgaaaatggcgacgacagaagaagtgcgattaaacagatcgcctccggccgtttcggcgtaaagagccattatctcgtcaatgcggatgaattgcagatcaaaatggcgcaaggagcgaagccgggagaaggcggtcagcttccggggaacaaagtatatccttgggtcgcggatgtccgcggttctacaccaggtgtagggctgatctcaccgcctcctcaccatgatatttattcaattgaagatttggcgcagctgatccatgatttgaaaaatgcaaatcgaagcgcgcgaatcagcgtcaagctcgtgtcaaaagccggtgtcggcacgattgcggccggtgtggcaaaaggcactgcggatgtcatcgtcatcagcggctacgatggcggaacgggcgcatcgccgaaaacgagtattaaacataccggtcttccgtgggagcttggtcttgcagaagctcaccaaacgctgatgctgaacggtttacgggatcgcgtggtattggaaacggacggtaagctgatgacaggccgagatgtcgtgatggccgccttgctcggtgcggaggaattcggctttgctacagcgccgcttgtcgttcttggctgcatcatgatgcgcgcctgccatttagatacatgtcctgtaggtgtcgcgacgcaaaatccggagctccgcaaaaaattcatgggcaatcctgaccatatcgtaaattacatgctgtttgtcgcagaagaagtgcgtgaatatatggcgcagttaggctttaagacgcttgatgaaatgatcggacggacagacgttcttcatgtcagtgaacgtgcgaaagcgcattggaaagcgggccagcttgatttatccacactgctgtaccagcctgaaggcatacgcactttccgtacggcgcaaaaccataaaatcgacgagtcgcttgatatgacggttattcttccggcggtgcaggctgcaattgaagccggtcaggaagcggaagctgaaatcaagatcaataatacaaaccgcgtagccggaaccgtgacgggaagtgaaatttctaaacgctacggagcggaaggcctgccggatgatacgatcagacttcattttaccggatcagccggacagagtttcggtgcatttgtccctaaagggatgacgcttcatttgaacggggattcaaatgactacgtaggcaaagggctttcaggcggaaaaatcatcgtgaaagcgcctgatgccttcaattatgaaacacacgataacgttattatcgggaacgtcgcattttacggagcaacaagcggggaagcgtacattaacgggcgcgccggtgaacgttttgcagtccgtaacagcggagtcaatgtcgttgtagaaggtatcggagaccacggctgcgaatacatgacaggcggccgggttgtcgtcctcggcgaagtcggcaaaaacttcggggcgggaatgtcaggcggtatcgcatacgtcctgagtgaagatgccaaagcatttaaacgcaaatgcaacatggaaatgatttcatttgaaaagctgacggatgaggcggagatcaaagaagtgcaagaaatggtcaaacggcatgcggcgctgacaaacagcaaaaaagccgcaaatctcctggacaattgggaaaaagccgcagaaacctttatcaaagtcattccgaaaaactataaacaaatgctcctcagcatcgaagaacaaaaagcggcgggtttatcagaagaagacgcaattatgtatgcttttgaagccaatacaaaggttcagcaaacgcctgccaaagatcaaaaacaagcggtagtacagtaagaaaggggagaggaacatggggaaaccaactggattcatggaagaaaaacgagaaaaaccggctgagcgggaccctctcactcgcttaaaggattggaaagagtattcggctccattttcagatgaagcgtcaaagcggcagggggcgcggtgtatggattgcggcacaccgttttgccaaatcggcgctgatatcaacggttttacctccggatgcccgatttataatctgataccggagtggaatgacctcgtctatcgggggcgctggaaagaagccttggagcgccttctgaaaacgaataactttcctgaattcacagggcgggtctgtcccgctccttgtgaaggatcttgtacgctggccatttcagatccggctgtttcaattaaaaacatcgagcggacgatcattgacaaaggttttgaaaatggatggattcagccgagaattcccgcgaaacgcacaggtaaaaaagtcgctgtcgtcggttcaggcccggcaggtctggcaagcgctgatcagctgaatcaagccggtcattccgtaacggtctacgagcgtgccgacagagccggcggcctgctgatgtacggcattccgagcatgaagcttgagaaaaatgtcgtcgaacgccgtattaagcttttgacgcaggaaggtatagattttgtgacaaataccgaaatcggcgttgatataacggcagatgagctgaaagaacaatttgatgccgtcattttgtgcacaggcgcccaaaagcagcgcaatctgctgattgaaggccgggaagcaaaaggcgtccattatgcgatggactatttaacactggcgacgaaaagctatttagattccaacttcaaagacaaacaatttatagacgctaaagggaaagatgtcatcgtgatcggcggaggagacacaggagctgactgcgtggcaaccgcgctgcgtcaaaaagcgcgcagcgtgcaccagttcgggaaacatcctaaacttcctcagacgcgcacgaacgacaatatgtggcctgaacagccgcacgtctttacccttgaatacgcctatgaagaagcgcaggcaaagttcggcaaagacccgagagaatattcaattcaaacgacaaaaatggtggccgataagcagggccgcttacaagagatccacaccattcaaatggaaaaagtcagaaacgaattcggaaagtatgaatttcatgaactgcccggtacagaaaaagtctggcctgctcagctggtgttcatcgccatcggttttgaagggacagaacagccattattgaaacagttcggagtcgattcggcaaatcataaaattcaggcggcatatggggattataaaacgaatgttgacggtgttttcgccgcaggggatgcgagaaggggccaaagcctgattgtatgggcgattaatgaaggccgggaagcagcgcgcgaagtcgacagttatttaatggggagcactgttttaccgtaaataaaggggtttatttataaaaccggctgggatcagccggtttttcgtattgaaatggaacctccttcttcttgtattggtcatataaaggtaatgtggaaatggaggataaatatggaattttgttttacagagcggagagattgtttttttccgcagactgatacgatttgcaagccttgcgcaatcgatcagggtgctgctgacggcggaagtcatcgctgccgtttaaaatgacgccttaaaaaacatgacgggctctgtgtgtctgcagtcgatttgcgggcagattttaatcgatgaagaaaaacatattgaatttcaagcggaaacgcttaaaaacaaataagggaacggacgggtccgttcctttttttagacatctatacgaaagccgatattgccgaactgccgtccttcccgcattctgttaaaagcgggagctgcttcactgagagggtacatgcggtcgataatgggacggagctcgcagcggtttatcaattccagcatatccgcgaattcctcattgcttcccattgatgtaccgagaatatgaatctgcggaaaaaacagcgagcgaatgggaaatccgagctgatcgcctgaactggcgccgaatgttacgatccggccattcggtttaataatgtcaagatagtgttgatataaagcggggcctacaccgtcaagtatgatatctgctttttcgccattcagcgcctcattccagtcaccgtagctgtcaatcgcccggtctgcaccgtatgacagtgcggtttgttttttgttttcactgcgggaggtgacgctgactgtcgctccgatagcttttgccattaataaggcatatgttgccacgccgcttccgatgcccggaaggataaggtgttcgcctttttttaattgtccttttgtaaataaggcgcgataagcggttaatgctgataacggcaggacgcccgcttcctcccaagtcaggtgttcgggttttaaaacggcattttccgcaggaacgatgacataaggtgaaaatgttccgtcgctcggaccgcctaaaatatcagggacggctggtacgtcctcaacagtcttccaattcagtaccgggttgatgatgacttctgcattcagtaaatgagaccggacgccgtgtcctatttcggttacgattcccgcgccgtctgaaccgagaataaattcatggtttccggtttcgtgttttttcattaaaaacaaatcacgatggtttaatccggctgttttcagctttatttttacttcgccgtttcccggccttttgtcaggtgcctgcctgaaattaaagccattttcgtgtatgataaggacattcatgattcttctctcctttatgattgatgagaaaaattttacaggctgtatcagctgcagtaaataaatgaaaattgatagccggctatcaataaaaatcatagcaagaaggtgcccttagatggaaagcggagacttaaagatttttcaggctgtcgcccgcaaaggaagtatttcaaaggcggcagaaagcctgcattatgttcaatcaaatgtgacaaaccggattcagcagctggaacggcaattgcaaacacagcttttttaccgcacaaatcggggaatgacgctgacgccaacaggtgaaaacttattaaaagacgcagacagaatccttcaattgctgcatgaggcgcaaaaaacagcgcgagaggcaggcgatccgaacggcccgcttcgaatcggttctcttgaaacggcggcagccgtccatctccctcaatttttcacggagtattgcagccgctacccgaaagtacagctgtctctgtcaaccggtgatacacataccttagtgcagcgcgttctacactatgagctggacggcgcttttgtttacggaccggtcgaatatgaagatcttgagcaagtcgctgtatttcaagaagaattggtcttggtttcaaataagcgggaaggcagtttgcaagacttgctgcgagagccgattctgtattttgccgcgggctgttcgcaccgccgcaaaataaaaaacatactgaaagaagaggcagtgcccgcacataaaatcattgaattcggtacgttggaagccattattggggcggtgcaggcggggatgggggtctcctttctgcctgcatcagccgtccgttattttcaaaacaggaaaaatctttttcttcatgagcttcctgaacattttcggaatatgaatatatcattcatctaccggagtgatttatttttaacatcggcgtttgaagaactgctgaatggattaaaaacattatcgaacagaagatgagaaaacaggacagctgtgtacgccaattttttttcgttccggtttttctcaaaaagaaagcgggtatccgggctgagctcgatcagcgtgatgaaaaactcggctataaaatcagagaagcacaaatgaaaaaaataccgtatatggcggttgtgggagatcaagagtgccgccaccattctgtacatgtaaggcaatacgggcgggaaaacacatttgaagagaatgtgagtgattttatttcccggatcataagagagacaaaacaaaaaatagagattcaagaaaaataacattgacatatcgcaaaatcacgatataataaagcgtatgaaacctattgatgtttttaaagcgttgtctaatgagtcacggcttgagattttacaatggctgaaagagccggaccgtcacttcgcaccgcatgatggcattgatatgaatgagatcggagtatgtgtcagccagatcaccgataagcttcagatgacacagtcaacggcgtctcaatatctttccattcttcagcgcgcaggccttatccaaacaaaacggattggcaaatacacctattataaaagagatgaagatgcgataaaggcgatggccgattattttcagcgcgaaatgtagggctgaatcctttagaagagggattcagtttcttttttcgactacacatcgacatattgcgatttgtttctgtttgttcaattctttatatcgatatatcacaatatatctttatataaattatcaatgaaggagtgtgtcaggtgcaaaatacctggaagatttacattttggcaattatcagctttttagtggggacgtctgaatatgtgatatccgggatgcttgataaaattgcaggttccttgggagttactgtggcagcagcagggcagctgattacgattttttcacttgtttatgcaatcggaacgcctgtcatgatggcccttacagcaaaactggacagaaggaagctcatgatctatgctcttggattgtttgtaatcggaaatatcatttcatttcttgtacagggatacggcttatttgcggcagcccgggtgatcatggcgcttggagcaggaactgtggtggtcaccgcgcttacgatcgcagcaaaaatcgctcccccgggaaaacaggcaagttctctcgcgaccgtcattatggggtttacggcggcgctcattatcggtgttccgatcggaagaaccgtgtctgaagcttttggctggaaggtggttttcgccggaattgcggcaatcggaatcattgccatgcttattatacgttttgcgttgcctgagataaaaggagataaaccggtgccgcttattcagcaattttctcttttgaagaaacgaaaggtggctgtcgggcttgctattacgtttttttggctcggaggctattcggttgcgtatacgtacctttctccgtatttactgaacgtcactcatatcggcagcggaatactgagtacattgctgcttattttcggtgttgctagtcttgccggttctaaagcaggcggtttcagtgctgacaaatggggggcgcgtatgacattaaccggcggaatggcgcttcatgctatcatgctcatgttattgccgtttgtcacacattctgctttcggagcggcggcagtgcttattttttggtccttcgccgcctggtcatcaggacctgctcagcagtatcatttggcaacgatggagcctgaatcatcgggtgtattacttggcctcaaccagtctgtgatgcagctggctatggcggccggggcgggcatcgggggcattgttgtcactcatctgtctcttgcgtcagtgacatggatcggatcagcgggtgttgtcatcgcgatgtgcggcgtgctttcacttgcctcgttaacatctgaaaaaccctcatctgaatacagtgcagaataaacaaaagcctcatttctcagcttgagaaacgaggctttttgcctagttattttttatattgtttcaagtttacgccgattgcggctccgtttcggcttgagtcggcaactccggtaaaggtgccgttttcacgatcgatcaggatgctttgcacattaccgatatcaaccgggctgctgccgaatttatgccccatttcgttcagttttgtgcgggcttcttccggcactcctttttcatatctataggatgtcatgctgtttgtgtaaattctcggctcttcgaccgccgctttcagatccatgccgtactcgactttgttcaggatcgtttgcaggacggaagaaataatcgttgctccgccgggagagccgacagtcaggacaggttcgttatttttgaataaaatagtcggagtcatgctgctgagcggacgtttattcggctgcacttcatttgcgccgccaggcaccgcatcgaagtctgttaactcattattcaacacaacgccgtatccgggaaccataatgccggaaccgaacagctgttcaatcgttgtcgtataagatacgacattgccgaagcggtcggttaccgtgaagtgggtcgtttggccttcttgtttgtcagtcggctgcttcacttgtttatagtttgcagaaccttcctgataggcccaagggtcgccggctttcggttttttattgactttatcaatatctatcagctgtctgcgggcattgatataatctggattcaagaggcctttgagagggacgttgacgaattctggatccccggcaaatgcggcgcggtcagcataagccaaatgcatcgtttctgcgagaagctgatatttttgccaagaacggatatcatattgagaaagcttaaaatcatccagaaggttcagcatttgcaacaggaaaacaccgcccgagcttggaggaggagcagttgcgatatgatagccctggtaatcccccagatcggttcgtcaatcgtcacattgaagtttttgatatctttttctgtcattgagccgccgaattcctgcactgtttccgcaagctttttggagaatgcaccgtcatagaatgcttttgtgcctttgtacttaatagctgtaaatgttttggctaagtctttttggatgagtgtgtctccttctttcagaggttctccgtccggaagaaacacgtcttttgcagcggtgtgtgataatttgtttttataatctgagatggcatcagctaaaaccgaatcgatcggaaagccttttgaggcaagtttaatggaaggggtgatgagttgtttcatggagcgtgtgccccatttgtcgagcgctttttcaagtccttttaatgttcccggaacaccgactgcagtccctttagtaacgcgttcggagaaagggatggctttgccgttttcgtcaaggaacatatccggtgctgcgcctgccggtgcgcgttcccggctgtcgataatggtggtgtctttcgtcttcgcatcataaaccatcataaatccgccgccgccgattcccgacatcataggttcagttacgtttaatgcgaattgaatggcgaccgcggcgtcaattgcattgcctccttttttcagcacgtcggcaccgatttgtgaagcgagaggatgggcggtggcaaccatgccgtctttgccgacatctacctgtttgtagtcgtcataggaaaacgggtgtttcttagcctgagcgtgataagggatgcttccggccgtgagcaaagtactgagcagaacgataaaacagagattcataaactttttctttttcatagtctgcctcctttgttttccgcttacaattatagagtaagtaaaatgtgctgttttcacaagtgacaaacggaatagtccggtgcgcaaaaagccggagtttctgtgtgaatgtaatcagtcgcaaataggctaaatgggaaaccgggcagaaaaagctgtgaaacaagcataaagacaaaaaataagctacaataaacaaaacagaattcactcacatgacatatgaaaggaacgtgagccatgtatttaacgatcaaagagacagctgagtttaccagtcttcctgaagaatatgtgcacaatcttgttttgacgaataaaataagggccgtacatgacggacagcaatatttaatcaacaaggaacaatttcaaacccatctcgaacagctggaaaaatataaggaaatgattcaagagtttttaaatgagccgcttcctgaagacattgatgtaaaagatgaagactaggacacaatttcatattgtgtctttttttttcatttttttcggttgctcacaaaaaaacgaatgctcagatttcgttttaagggcgttgtttttcttttttaataccgtgagtctctgttgatttaaaatcccgtcatcgggtcgaaaatgatgttttgaagacttcgatgaaactgcgtgccttattccccttatgtaacactatgtatattatgttacataaggccctttatcctttatcattcaacaggtttcggctataatagtaacataatgctcaatatgttactttaccaattataaggggttttttgatgcatatcgtacagccgatccgaagtttggagaagatccaggaagtcaaacagtatttaatgaagaaaagtgatcgtgattattttttatttattttcggcatgaacagcgcactgcggatttctgatgttctgccgcttcgcgtgagggatgtaaggaacaaagaccatgtgtgggcaaccgaaagcaaaacgagaaagaaaagaaaaattctgatactggagtctttgaaggccgacatatacgcttatacaaaagacatgaaagaggatgactatttgtttaaatcgaaacggacgaataagcccatttcccggattcaggcatacagaatattaaaggaagcagctgccgcgtgcggattggaggaaatcgggacgcatacgcttagaaagacgttcgggtatcatttttatcagaggacaaaagacattgctgaactgcagaggattttgaatcattcttctccgtctattacaatgcgttatatcggaatagatgaagatacgacgagagccgcctataaagtgttcggagggctgtaggcttgaaaaaaacggccgccagcgttactataatagaagcaggctctagtagcacagcggatagtgcagcagtttcctaaactgcaggtcgggagttcgaatctctcctagagcgttttcgacataagataggtgcggattaataatgtcggcaagacagaaaaccccttgttatacaaggggtttttgagtttaatattttgcaagaacctggtggaaatgatgtgaaaaaagcccgctgtaagcaagcgggctttttcttatatgacagcatcaaattgattgactttccaaacgttgttttcttttacgaatgttacatcgcgttttgctgacggtgaaccgtcaagagtcggtacagtgaagcggtatgtttgaacgcttccttttttagaaagaagagtcatttttgcttttttccaattcaggaggttatctccgtcgccgagcggaacagccaatttgccgtcttttacagtgaagtggtaatctttgagccctttgtcaatcgcttgctttgtaaaagcgggtgtcagatattttacggctttcgcttttgttccgaggtctttgcacataaagacgtattgaagattttgatattcaaacggttcagatgtgcagtttgcgtttgatttaagcgcaccgccgctcatcgtgttccagaaatgttctctcgctgacagggccagctgaagtgcttgtttttgtgtaaggtcattaggtgcattttttgcggtcgccgcagtgcccaatgacagaatcaatgtaatagtagtgaggaataatagccattttttcatgatataatctctccttcaatcaatctctttctcttatgttacaaatgttacaataattacgataagattacaataccttttcagaaatattttccggactttttatttttatggtttatttccatgtaagacgtgagaataagataaagagtttcattgaacaaaaggtttttacaagctgtctgctgaataataaaatggaagaaaatcaaaaaaggagtcctacatatggaagtacaagatcatttagaaacagcggaaggccgcggccagtctgtctggcgatcgatgtcactgtttttagtgccgctgcttttaagcaatgtattgcaatctgtcggccaattggtcggaatggtatttgtcggaaggtggctcggagttgatgcgcttgccgccgtatcgtctttttttccgctgttttttctgctgatctcctttacgatcggaatcggttcgggaagttccattctgatcgggcaggcttacggcgcgaaaaacgaagagaggatgaaggcgattgtcggcactacactgacttttacctttatgctcggtgttgttctggcagttgtcggcagtgtgtttacgcttgatattctgcggctgatgggaacgccggaaaacgtaatagatgtcagtgtccgatatgcgcgtattttgttttgcgcaatgccgctgatgtttttatattttgcgtatacgacatttttacgcggaacgggagattcaaagactccgttttatacgttaatcgtcagtacagtcataaacatcggtctcttgcccttattgattctcgggcttttcggacttccgaagttcggcatttacggttcggcgtatgcaaccgtgatttcaaacatcgtgacatttatcgtactcatggtttatttgcggaaaaggaaacatccattggcatttgaccggactgcgctccgttctcttaaaatggacaaaaagctgctcgcgcttttactccgtctcggtattccgtcaagcatcaatatgattctcgtatcactttctgaaattgcggtcatttcatttgtcaatcattacggatcaaacgcgacggctgcttacggggtcgtcaaccaagtggcgagttatgtgcagatgccggcggtaagcctcggtatcgccgtttcaatttttgccgcccaatccattggcgccaatcaattcggccggctgaagcaggtcatcaaagtcggcatcggcctgaattatttgatcggcggggttttgattgtgctgatttacaccttctcccggcagatactggctttgtttttaaccgatcaggatacactccgcattgcccgcaatctgattatgattaccctttggagctatctgattttcggtcacgctcagattgtttcagcaacaatgcgggcgagcggtacggtgttatggccgacgattatcagcatttttacgatttggggaattgaagtgcctgtggcctttattctttctcattatacgaatctcggcattctcggcatttgggtcggttatccggcggcttttgtcgtcagcctgctgctgcaatacggatattaccggtttgtatggaagaaaaaacagattacccggctgattcaataaggttttaccgcacatcgctcagttcatacgggcgatgttttttttagagaaggaaaatgagtttagaaaatggaattcctatacatgctagaaaacaaggaaagggcaggtgcttatgacgattgaacatacgacttatttaggagtttcagccataaaggcggagactgatcaggctgaatgcatcattgtgccggagtggggatcaaatgtcatatcgcttcgggataaaagaaccggtatgcggcttctgagagaaccggaaactgcggaggaattcctcaaaaaaccgatgctgtacggcattcccgttttattcccgccgaaccggattacggacgggacgtttcgttttgacggccgctcgtatcaattcgagataaacgaagaggataaacataatcatattcacggctttcttcacaatcagcattggaaagcggcagcagcgaaagaagagggggatggaatgacagtcgaaacagaaattgatctttcaaagattccccgtgttcataaacaatttccgcacgatgtcattgtccggatgacctatacattaaaagacaatgtgtttacgcagcgggcgctgattatgaataagggaacggaggcttttccttgggggctaggctatcattccacatttgttttcaatgaagagcaatcccgtctatttttgacggctgaccgcatgtgggaattaaatgaacgtttcgtaccgacgggccgtttattggatgttcctgataaagaagcgttccgtcatgggatgtctttgaaaaataaacagtttgacgatgtttttctttcttccggacggaatggcggcaataacgaagctgttatttatcatccgaatgagaaattatccgttttgtatcaggcagacacgtctttcaagcattgggtggtatataacggtgacggaaagcaggggtttgtcagtcttgagccttatacttccgttacagatgcatttaatctgaatcagcctgcatcactgacagggcttcagattctgaaaccgggcgaagaagcggctgcgtcatccgggatcaccattttgcatgacgaagaataggaaagaggcgggataacattgaaaacatatgtgaaacgcttgtgcgcggtgattctgcttttgatcattgccgaagttccttatattgatgatgcggctaaggcggctgaacaaaaaaatactttgcaaaaagagctggaacacattctggatgaagaacccgctttaaagggggcttcagcgggcatcattgtccggtcagcaaaaacaggggaggtgctgttcggcagccgggaagatatgcggctgaggcctgcatcattgatgaaactgctgacggcatctgcggcgctttccgttctcggagaagattacacctttaagacagaagtacgggcagacggcgccgtgaaaggaaaacagctgcgcggaaacctttatctcaggggaaaaggcgatccgaccctattggcttctgattttgagaagatggctaaacaggtcaaagccagaggcatccatgtcattaaaggagatctggtcggggatgattcgtggtatgacgataccaggtattcagttgatcttccgtggagtgatgaaggccaatattatggcgcgcaagtatcagctcttaccgcttccccaaatgaggattatgataccggaacggtgattgcggaaatcagcccggcgaaacagcccgataaaaagccgcgcatttcaatttctccctatacggacatcgttcgtgtgaaaaatgaagtaaaaaccgtcgcttctgatgaaaagaaagaattgacggttgaacgggagcacggtggcaatgtgattacgataaagggagccatacctgccggctcggcaaaggcaagagaatgggcggcagtgtgggatccgtcgtcctatgctttagatttatggaaacaagcgcttactaaacagggtgtaactgtaaaagggaaaatcagaacaggccgaatgccgcaccgcacccagcttgtcacatcacggacatccatgcctctttcagaattattgatcccgtttatgaaactgagcaacaacgggcacgccgaaattctgatcaaggaaatgggaaaagtgaaaaaaggggagggcagctgggaaaagggcttggacgtgatgaaatcggagctcaaatcgttcgggctcaatccggatgaattgattgcaagagacggatccggcgtttctcatattaacggcgtatccgccggccaaatcggagagcttttgtatgcggttcagaaagagaagtggtacccggctttccttcgttcgctccctgtcgccggtgcaagcgacagaatgacgggaggcactcttcggaaccggctgaagaatactccggcagagggcaaaattaaagcaaaaaccgggtcactaacatcagtcagttcgattgccggctatgcagacacaaaaacaggagatacgcttattttttccgtgcttcaaaacgggctgcttgacgaagatgacggaaaagacattgaagacaaaatcgcagtcgtgctggcaaatcaataagaagggccggatccttagagggttcggcttttttgatgtctgtaaaacattatattgcgattatgaatcaatcttttcaaaaagtaatatcggcaacattcttccttttttttacatgatactttcttacttgttcactgatttttcattttttatcataaaatttcttttcggaaagcaaaacctttttaaaagcgcaattaattatacattttattccttattatagtgttttagaaccagtttgcagtgtacatacatactgttttacatggtataaaaattatagaaatgaagaagtgaagtgaggaatatatactatattctaaaaaatgttagaaaaaatttaattttttattgtgatttctaaaatatgttttaaaataatgcttatatggatgatttagtcatatgctgtcgaaatttaattgtaattatttcactttcttatcctcttaaattgaaatggagggattccattgaagaacactgtttattctttaactcacgcccaaagaagagtctggtttacagagctgctcgagccgggcacaagtatctgcaatcttgcggcgtgcgtcaaattcagggggaatatcgactttgacgtattgcgccgtgctttagatttctctatcttgcaaaatgattcgctcaggtttcaactgacggaaggggacggctcagaaccccagctgtatctggccgggcatcggccgatttctttagagaccgttgattttactcatattgatcaatcagagcgggatgcatggattgacaaacagacgcgtgttccgttcaagctgtttcattcaccgctgtatcattttactctgcttgtcatgtcagacgaagaagtttggctttattcaaaatttcaccatattattatggacggcatctcgctcaatctgcttggcaatcagctcattgaaatctaccaaaaaatcatgcgaagcgaggatttggccgaacaccaaagcccttcctatctcagctacatggaaaaagaacagcaatacctacagtcttcccgttttcaaaaagaccgttcattttggactgaaacataccgaaccgttccggaacacctttcactggcggaacgaacctctcatcttagacaaagcactgcagcttcaagagatacaatcactctttcccactccttagaacaatcaatccggcgtttttgcaaagatcataatgtcagcatcatctctctgtttatggcttcgttatacatatgcatcagccgtctgacggctaaaaaggatattgccatcggtacttattacggaaaccgcggttccaagctcgaaaaggatatgctcggcatgttcgtcagcacgctaccgatcagaatgacggcagatccggatgcggagttcgtgtcttttgtccgcagtgtaggaaaacagcagctgtctgttatgcggcaccagaaatatccttacaatctttttgtcaatgaattaaggcagattcatcacgacctgcaaaatatcatcgggatttcgatgcaataccagcctctcgcgtggcgtcaggcagaaggtttcgattatgaaacggcgatgtttttcagcgggcatacggcaaatgagctgtccattttaattaaggagcggacagatacgggattgattgagctgaattttgattatcaatccgctttatttactaaaacatcgattaaacgaattcaaactcatttgctgacgatcgttgaaaatgccgttagaaatccaaaccggctgattcggcatattgatatggcggatgaaaaagaaaagaaacgggtgttaactgcgtttaaccatacagaaacggctgaaccgccggccccgacgcttcacgggctgtttgcccgccgcgccgcgctttcgccgcatcgtccggcgctccgttttccgggcggtatgctgacgtacgctgagcttgaccagtacacagacaggctcgccgttcggctccgccaaaaaggcatccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcgggatgttcgtcaacacgcttgccatcagaacggagccgaagggggacaaacggttcaccgattatttggcggaagtccgccaggcggcgcttgaggcgtatgaacatcaggactacccgtttgaagagcttgtggagcggctcggcgtgcagcgggacatgagccgcaatccgctgtttgatgtgatgtttattcttcagaatatggagcgggaggagataaatctggccggtctgaaggcgtcacgatcaaagcataccgaacatgatgtatcaagttttgacctgaccttatcagcggctgaatccgatggaaacatccgctttgagatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagctgtttgaagagaaagcagaagaaacgcctcatcagaccgctgttattgaaggagcacaacagatcagctatttccagctcaatgagcgggcaaaccgtcttgcccgaacactgcagaaaaatggattcggtccgggaaaaagagcagccatattagcaaaccgttcgattgaagcgatcgtcagtgttcttgcggtcatgaaatcaggaggagcgtatataccggttgactcccattatcctgaggaacggattcgctatttattaaaagacagcgcggcatccgtcttgatggtgcagtcagaatacaaagaacttgcttcacagctgacggatcacaatttatttctcattcagcttgatcatgaagatcaatacgatatttccgcaaagaatattcagccgacagcgtcaccggatgataccgcatatatcatatatacttcgggaacaacgggaacgccgaagggagtcgaagtcagaaatcgcagctttacgcatgcagcacttgcatggcgcaggatttatgagcttgatcttataccggtcagagtgctgcagatggcgagtttctcatttgatgtattttcaggggatctagcacgcgccctgctaaacgggggaacgcttgtcatttgtccggatgacgtccggcttgagccgcagcagctttatcggctcattgatcagcaccgtatcacgtttatggagtcgacacccgcgctgattgttccgtttatggaatatatataccgccggaaactcgcgctgcaaagcgtaaaaatactggtacttggttcagatatgatcaagtcgcaagatttttatacgcttcatgaacgctttgggaaagaaatgcggatcattaacagctacggtgtaacagaagcgacaattgactcttcgtattatgaagccgaaatgagcgaagagccgcgggaagatgatgtgccgatcggtgttccgcttccgaatgtgcaaatgtacgtcttaaacaaagacaaacaggtccagccgatcggcgttttcggagagctgtatatcggaggcgccggcgtcgccaaaggatattggggacagcctgagctgacagaggacgcattcagtgacccgttacaaacgggagaaacgctttacagaaccggagatcaggcttgctggctgccggatggaactcttcgttttaaagggcggatcgataagcaggtgaagatcagaggctacagaattgagacgggagaaatagaaagtgtgcttttgaaacacgatcaagtcaaagaagcggctgttaccgtgatgaaagatgccgaaggacaagcacgattagcggcatacgtcgttcctaaagaggccgatatctcatcactccgccagtctcttatgcaggagctcccggcttatatgatgccgtctcatattatcggtttagacagcatgccccttacactgaacggcaaacttgataaatcggcattgccggcagaagagatacattcatcacaggcatttgtcgcgcccggcgatgaaaaacaggcgatgttatgccggatttgggaagatgtgcttcatattcagaaagcgggaattcatcactctttctttgagcttgggggagattccattaaggcgcttcaagtgtcagcccgactcgccggagaaggctggaacatgtcgatccgcgatttgtttcagttcccgacgattgcagaactcgcgaagcacctcacgccggctgttgcaacggctgatcagggcccgatagaaggaagcgctccgctgacaccgatccagcagagattttttgaggagccgggtgcgtttgagcttcattataaccaatcagtcatgctgtgcagtgaagacagcctcgaaatagatgcgctgtatcaggcggtttgcgcgctgacagaacatcatgatgcgctgcgaatgactttcactgaaaatgagcatggggaagttgttcaatataaccgcggaatcacagagcagcatgaagaaatctttacgcttaacgtcatagatctttcagaagaaacacagccggaaaaacggatagccgctgaggaaaaagaaatacagcaggctatgcgccttgatcaaggccctctgcttcatctcggagtgttcaggctgaaagaagccgaccatctgctcatcacgattcatcaccttatcacggacggcgtgtcgtggagaatattgcttgaagatctgcagacagcatatcagcaggcattggacggcaaacaaatcgaactgccgccgaaaagcgattcttatataaagtatgccgaagagctttttgacatttccaagagcaaagcattgctggaggaagccgcatactgggacagcgtgatgtctggtgaaacagcgccgctgccgaaaataactgatgaaaacgccggacgattgcaggaaaacgcgcgcactgcatcatggatattaagcagcgaagtcacgaagcagctgctgatggaaacacagcaggcgtacggaacggatgttcatgaattgcttttaacggcgcttggaatgacgcttcatgagtggacgggttccgaacagatccttatcagcactgaaggacacggacgccaggggcatattcctgacattgatatgtcaagaacggcgggctggtttacatctgtttacccggtgcttttggatatgagagtgccggacggctcaggggaaacaaccgcgcaccgcataaagacggtaaaagacatgatgagacgggttcctcatcacggaaccggctacgggctgctgagatattcgcgaaacattctttataaagacccagaaataagctttaactatctcggtgcgtttgacggtcttgaggggacgctgaagatgtcaccgttcaagccgcagcatgatatagcggccgggcgcatccgcgagtttgatctggatattaacgcgatggtggcggccgggcaactggaggtaaaagccgtttataccgatgtatttgcaccgggggcaatcgagttcttcatgaatcgtttccatactcacctcggggacatcatcgcccactgttccggcaagaaagagcgggaaaaaacattaacggattacagccatacagaattgaccgctcaagccctatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgttgagcagatttcgtttacagtcagcggggatttatgcattgatacattccaaaaaagtctggatatgcttgtcagccgttatgatattttcagaacgattttcataaaagaagtgcctgaccttgaagggccgcagcaggttgtcctttcacgccgtgacactgccgtacggactgaagacatttcagattattcggaagaacggcagcaaagcatcattgacaaattcaaggaaaccgaccggcataaggggtttgatctgcaaaaaggccccttaatgcgcctgactctttttcaaacgggagaaaaccgccatacgtgcgtttggactcatcatcacattatgatggacggctggagcttgggccttgtactgaaagatttcttcagcatgtattatgcgatccggagcgggcggcctgtaaacctcggcagtccggctccttacagcacttatatcaaatggctccgaagccggaataaagaagaaacgtcagcattctggtcgcgctgcttggaagattacggagaaaccgtttccgttccgcaaacgaagaataagacggcgcaaaacggttatgcatctgagcatttccaattttcccttgagcctgaaaccgtacaaaaactgacagacattgcccgaggcatcggggtcacgctgaatactatatttacgggcatttggggtctgcttctccatcgttacaacgggactgaagatgccgtcttcggttcggttgtttccggcaggccttcagctatcagcggcattgaatccatggccggactgtttatcaataccgtgccggtaagggtgcgcgcggctggtgatatgactttttcttctcttctcaaaaaggtgcaaaaagagtcactcgctgcggaagagcacagctattatccgctttatgacattcaaaacgagagcggcctgcaaaaagatctcttgaatcacatcctggtttttgaaaattatccggttcagatgcaggctgcggtaaacggctggcagcaaacggaaagccatgcgctctcacttgaaaacttttcgatggcggaggaaaccaattacgatcttaacgtcgtcatcgttccgggagaagagttttatgtgaaattcagctacaatgcgggcatctacgatcgggaagacatgaaacggatcaaagggcatattctagaggtcatctcctgtgtaacggaagatccggacaggcttttatcaagcatcagtctcgtaccaccggaggaagaagccctgattcattcgtttaacgaaacgaaccgtccgtaccctgagacaaccgttcatgggctgtttgaagaacaggcggcaaaaacgcctgaccaagaggcgttgagatataacggggtaagctggagctacaagaaattaaatcagcgggcaaatcagattgcccatgcgttaagggaaaaaggcgcccgttcagatcagatcaccgctgttatgctgcgccgatcaatgagtacggttgccgctctgctcggaatttggaagtcgggcagcgcctatatgccgattgatgcggaatttccgcctgaacggatttcatttttactgagagacagtgaagcctcactgctcctgactgaaaaagacctgctccccctcattccgccgcatttcaaggggagcgtcgtcatcatggaggaaacggtttcccagcagactgcaccgcttccgccggtgtctgacagcggaaattgggcgtatgtcatttacacttccggaacgacaggccggccgaaaggggtgcttgtacaacacaaagcgatcagcaatacattgcaatggcggcgtgaagaatacgggatgacagaaggagacatagcgcttcatcttttttcatacgtatttgacgggtcattaacgagtcttttcactccgcttctgtcgggcgcctgtgtactgttaactgatgaagatgatgcgaaagacgtcctttcaataaaacagaaaatcgcccgccacggggtaagccatcttctgatcgttccgtctctgtatcgcgttctgcttgattcgctgacgaaaaaggatgcgcagacgcttcgggcggtgacatttgccggggaagcggccactcctgatatcgtggaagcgagccgcaacatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcaaccggtcggagccgtcggtgaactgtgtatttccggaaaaggtctggcggacggatattttcagcaaaaagagctgacggacaaagtctttacccctcatccgtttcgtaaaggtgaacggctgtacagaacgggagatgcagcccgatttttaccggacggaacgattgaatatatgggacgctttgacgatcaggtgaaggtaagaggttacagaattgaattaggagaaatcgaaacggcactcagaagtctgtccggggtaaaagaggcggcagtcatcgtgcgcaaaacggcggacggggaacaggagcttgcagcttatgccgtactggaaaacgcgggtgtgacatttgatcctcatgccgaattggccgggagattacctgcttatatgatcccgggaagctttaccaaattgacggaaatgccgctgtctgtgagcggaaaacttgaccgggccgcacttcctgagccgaaagaagccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagccgcgtcgcttgtttcaaagatacataaacggctgcaaattgaacttgccgtccgccatgtttttgaacatccgaccatcgagagcatggcccgcttcctagaacagaggaaaagaggagaatatgcagaaatcacgcctgcggaggcaaaggacttgtacccgctatcttttgcgcaaaaaaggctttatgcccttcatcagcttgcggcggacagtacgggctatcatatgcccgcttgtctggaactgagcggcagactcaaccgtgatcgtctgcacgaagccttttcagcgctgttacaaaggcatgaagcgttacggacatcatttgttttacgaaacggggagccgatgcagcacgtacattcacatgtcgatctcgatctcacagagattcacatgccatccgggacacttcttcaagaggcgatggaaactttcgtcaaaccgtttgacgtggaaaaagcgccgcttttgagagtgactttagccaaagccactgaagaacgtcattttctgctgcttgatatgcatcatcttattgcagacggtgtgtcaatgagcgttctgatccaagaattgacggatttgtacagaggaaaagagctgcggccgttaaaacttcagtacaaagatttttccgtctggcagcatgagcggttcgccgctgaagaattcaaaagacatgagcggtattggctggatgcgatcggggaaaatattccccttcttgatctgccgctcgataaaaagcgcccgcagcttcctgatttcagcgggtccgttgttcgaacgcgcctacaaaaagaaacggcggagaatttgcgccggctcatggatgagacgggttcgacactgtatatgattcttttggcaggctactccttgttcctttctaaattgagcgggcaggaggacattgtcgtcggttcacctgcggccggcagaagccgcgctgagcttgatggggtcatcggcatgtttgtaaataccgtggcaatgagaagcaggccgaaaggggataaaacattccgcgcttatttagaagaggtgaaaatgctcgccctcggcgcagccgaacatcaggacttcccgtttgaagaacttgcccaaaagcttgatacacaccgggaagtcaatcgcaatccgctgtttgatgccatgctcgttttgcaaaacagtgatgatttcaaagtgaaccttccgggcttatccgtttcttcacatgcagtgaaacatgacatttcaaaattcgacttgacgcttcatgccgaggaacggccggacggctcactggattttcattttgaatacagtaccgcgttgtttgaaaaaggtacgatcgaacggtgggccggtcattttaaagagcttttaggacaaatcgcatcggatgatgagcggaagctgtctgacattcatttgctggacacaaatgagcggcagatgcttcttcaagcggaaaatcaaacagctgagtatccgaggcatgagacgatcgtcagtttatttgaggcacaggcggaaaaaatgccggatcaaattgcagccgttatgtccgatgagcgtctcacctaccgcgagctcaatgaaaaggcggatcgaatcgccgatatgctgtcggaaaacggcatccgctccggacagattgtcggaattatgaccgaacgatctcctgaaatgctgatcgggattttcggtattttaaaagcgggaggagcttatctgccgattgatcctgactatcctgacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaatgataacgcctgaacagccggcttacgtgatttacacatcgggcacaaccggaaaaccgaaaggcgttatgacggagcaccgcaatgtcatcagccttatcacacataaaggactgccgtttgatttcggcactggagacgtctggaccctgttccactcctattgctttgatttttctgtctgggaaatattcggcgcgctcttatacggcggaaaggtagttatcgtgccgaaagaaactgcccgtgatccgcatttgtaccggcagctgctgcaaagtgaaggcgtaacggtgctgaaccaaacgccgacggctttttccggactcattcatgaagaagccgggcatgcggacaagctgaagcttcgatatgtcattttcggcggagaagcgctccagcccggcatgctgaaaagctggaaagagaagtacccggagacagagcttgttaatatgtacggcattacggaaaccacggttcacgtcacatgcaaaaaactgaatatggatgatattgagagaaataaaagcaatatcggcagaccgctggaaaccctccatgcttttgtcatggacgcctatatgaatccgcagccgatcggaattccaggtgagctttatatcggcggggaaggcgtcgcgaggggatatgtaaacagggatgatttaaccgcctcccggttcatcacgaatccgcacattaccggcatgcggctctaccggacgggcgatattgccaaaagactctcaaatggcgagctggaatatgtcgggcggaaagatgcgcaagtaaaagtcagaggccacagaattgagctgggagaaataaaatcagcgctgcaggagctttccttcgtgaaagaggccgccgtgatcacacgtgctgatcagcacggtcagcactccatttacgcatacgcggtcttacacgggaatgaaaaaataaaagaagcagaggttcaggcctctctcagagcttttctgccggaatatatgattcccgcccgcttgatagagcttgatgaactgcctttgacggcgaatgggaagctggacgagaaggcgctcccgcagcctgaattaaatgaaagccttggagatgatatcagcctgagaaatgaaactgaagaaatgatggctgacatctgggaagaactcttaggtgttgaaggactcggccccaatgctcatttcttccatctcggcggggattcgattaaagcgctgcaagtatgtgcgaggctgaaacagcagggctatgaaacgaccgtccgcgagctgttcgagcatcagacactgggagaagtctcgatgcggctccggaaagtccgccgcgtgattgatcaggctcccgtcacgggagacgtgccgctgacgccgatccagcactggttcttttcgcaatcattgccgcatgatcattttaatcagtccgttatgctcagcagtgcggacaggatcaatgaatctgctatgagaaaagcgctggcacagctcgcggttcatcatgacgcattacggatggtatgcggcacgcaaaacggatcagtgattcaatataacagagcggataacctttctgaagaagaactctttacatttgaaacgcatgacgtgagagggaaagggttattacaagaggaacacgccgcaattgaacaggcggccgcccgcattcaaacttccattcggctggagacgggtccgctcgtagctgtcggtttatttcacgctaatgatggcgatcatctgctgctttccattcatcaccttgtcattgacggagtgtcatggcggattttatttgaagatctcaccgcgtgctacaggcaggcgctcgaaggaaaagaagccgcgcttccggcaaaaaccgattcctatcagacttacgcgaagcaaatctctgattatgcaaaaagccgccggctgttacaggaagcagactactggtccgaaagagaaaaagcggcggtcaaaccgcttccgaaagatgcccgcatctcttccaatcttctgaaagatacagatgtgatgaccgttacattgacaaaacaggagaccgagcagctgttaacggaagcgaacagagcatacacaacagagacgggcgaattattgcttgccgcgttaagcctagcgctgaacagatggaccggaaacgagacattcaaaatcagcatggaaggccacggaagggaagagcacctggagcatcttgatatcagcagaaccatcggctggtttacgtcaatttatccggtattggttgacgcaagttttcaagatcagcctgatgacggcgagcgtctcggctatcacattaagcggacaaaagacatgatgcgccgcataccgcataaaggagcgggatacggggtgctgaaatatataagcaaactctggggagagactgaatctgattctcctgaaatcagttttaactatctgggacagtttgaccgggaaatccgttccagcggcttcggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacgattgaagttttgacgggatattttcatacctttctcaagcagattatcacgcattgcacaggcaaagaggagcgtgaatggagcgccgctgatttcagtgacgaggagttaacgctggaagatctgagtgacattatgggagccgtcaacaaactatagaaaaggagtggcgcaatggggcagcaaccggaaatacaagatatatatcctttgtcttttatgcaggagggcatgctttttcattctctgttggatcatgactcaagagcctacttcgaacaagcggtgtttacgatcagcggacagcttgaccgggaacggttccaaaaaagtatagacactgtttttgaacgatacgatattttccgtacgacatttattcacaagaatgtggcaaagccccgccaagtcgtgttgaaaaacaggccgagccgcgttcagtttcatgatatttctcatttggacgagaaggcacaagacaaatatgccgaccggtttagaaaagaagataaagataaaggctttgatttgcaatcagaccctctcatgagagtctccattttgaaaaaagcgcctgaacgctatgtttgtatatggagccatcatcatattgtcatggatggctggtgcttcggaattgtcatgaaggaatttctgatgatctatcaatctctcggagacgaacggcttccgttcctcgagcccgttcagccatatgggaagtatattaaatggctcatgaagcaggatcgtaaagaagccgagattttttggaaaacgagacttgccgatcttgagcaaacggcgtctcttccgaaaaaatccgcggaaccaaacggcgaacttgagcaggcggttttcaccatttctgaagagcagacaaatgagctgaagaacattgcggcaagggcgggagcaacgctgaatacagtgttccaggcactgtggggcattttgctgcagcgtgtcagccgctgtgatgatgccgttttcggttctgtcgtttccggccggccgtcggatctcgcaggcgtggaaaaaatggtgggactgtttatcaatacgattcccgtacgggtgaaaagcggttcattttcttttctggagcttgtcaggcatttgcagcaggagacgctgcaagcagaagcgtacagctattatccgctgtatgacattcaggcgcaaagccctctgaagcaagcgctgtttgaccacattatcgtgtttgaaaatgtgccggcccagcgtgaaattgaaaatgtgagtcaggccggttcatttgattttgcggtagaggattttacgatggaagaagtcacaaactacggatgcagcataaaggtgattccgggcaattctctttatatccgcttaaaatttgataccggtatatacgacgatgtttttatgaagaatatcgaaacatttttacggcatatggtgaactcagtcatttccgaccctgaaatcggcgcttccgagatcgcattgctggatgcgtgtgaagccagaagtatgatggatgcatttaaccatacagaagcggttgaaccgccggctccgacgcttcacgggctgtttgcccgccgcgccgcgctttcgccgcatcgtccggcgctccgttttccgggcggtatgctgacgtacgctgagcttgaccagtacacggacaggctcgccgtccggctccgacaaaaaggcgtccgcaaagaaagcatggtcggcgtactcgctgaacgctcgccggagatggcggtttcagtgcttgccgtgttaaaagcgggcggcgcctacgtgccgcttgacccggagtatcctgaggacaggctgcgatatatgcttgaggacagcggcgcttgtctcctgcttgcacagccggggttatccgtttccggtttttccggtgaaacgctagaagtgtctctttcttctctgacaaatgagacggagacaggggctgtctctgaagaagcggatgctgattcgctcgcttatatcatttatacgtccggttcgacgggaacaccgaagggagtggctgttgaacaccgtcaagccgccgcctttttatcagggatgcaagggcagtttccgttaacggaagaggatattatcgtgctgaaatcatccttttcattcgacgcctccatctggcaattgttttggtggacgatgtccggcgcctccgtgtatctgcttccggccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaacactgacacgcgtgttcgccggaggggaagctctttccccgcttacggctgcccggtttgccgatcttctgccggagaccatgcttattcacggctatggaccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcggtcgttcagacggacaggtgaaagtccgcggctaccggattgaaccgggggaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacactgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagctcgtatgaagcgattcagcctgcgcaaacacaagatacctacccggtgtcttcagcgcagaaacggatgtatgtgctccaacagcttgaagacggcggtgtcggctacaatatgccggctgtgctggaactgacgggcccgcttgaccgtgtccggctggaggagacgttccggcagcttgtggagcggcacgagtcgctcagaacgtcctttgaaacggggcctgacggcgaaccggtgcagcgcatccatgacagcgtgccgtttcagctcgatgaggccgagtcagctgacgcattcgtccggccgttttgtctggaggaagcgccgctcttccgtgcggccctcgtgaaagaatcggaagaacaccatcttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggatatcagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgctgctcgcgcgattgagcgggcaggaagacatcatcgtcggatcgccgattgccgggcgcccgcacaaagaccttgaaccgattctcggggtgttcgtcaacacgctggccatcagaacggagccgaaaggagacaaacggcttaccgattatttggcggaagtccgccaggcggcgcttgaggcgtatgaacatcaggactacccgtttgaagagcttgtggagcggctcggcgtgcagcgggacatgagccgtaatccgctgtttgacgtgatgtttgtgctccaaaatatggagcgtgaatccctgaatttaaatgagctgcatttgactcaagccgcggatgcaggtcataaaaccgcaaagtttgatgccacgctttacgcggcagaagggtctgacggttccatcagctttgattttgaattcaatacagatatctatcaaaaacagacaatcgaaaaatggctttcttattttacccgtattcttacaaaagtaattgaagaccaaacaataccgcttggtgacattcacgtactggatgatgctgaaacaaatcgcgttatttatcagtttaatcagacgaaaagcgattacccaagacacgaaaccatcagccgtttatttgagcggcaggctgaagaaacccccgatgcccgggcagttgtatatgatggacaaatcttgacataccgtgagctgaacgaacgggctaatagaatagcggcggctctccgatcaaatggcgtcggtccggaaagtgttgtcgccttattaaccggacgtacaacagagcttgcttccggaatcctcggaatattaaaagcgggaggcgcctacttgcctatcggtgacgatgtgcctcgggaacgggctgaatggatgcttaaagactgtaaagctgatattcttctccaatctgataaacttgacggtctgccgctttccggaaaacgtttattcatagaggatattcaaacaaaggccggcttaagttcggaaaatcccgaaccgctcggcggacctgaatcattggcctacatgatttatacatccgggtcaacaggtgcgccaaaaggcgtcatgattgaacagcgaagtgtgatccgtcttgtgaaaaacagcaattatattgattttacgccgaaagacagactgttgtttacttcatcattaggatttgatgtaacgacatttgaaatattcggtccgcttttaaacggtgcttctttatatgtaagtgaccaggaaacctatctcgactctgatgttctggaaacatttatacagcaaaacggcattacgacactgtggctgacatcgtctttgttcaatcatctatcagaacaaaatgaacacgtgttttccggattatcccgattgattatcggcggggaagcactgtccccaagtcatgtaaaccgggttcggaaaacgctgccgcatctttcaatatggaatggatacggaccgactgaaaacacgacgttctcgacttgctttttgattgaacaatcatacgatcattcaatcccgatcggccgccctgtcggaaattcaactgcatatatcataaacagcaggggaacaccgcagccgatcggcgtcatcggtgaattatgcacaggcggagacggtgtggcaagaggatatttcggccgccctgagctgacggaagaaaaatttgtccctaatccttttgttcccggagaacggatgtaccgcaccggggatttagcccgctggctgccggacggaacgattgaatatgccggacggatggatgatcaagtgaaaatccgcggttatcgggtcgagctgggagagattgaagccgcactaaggagcctggacggcgtgaaagaagctgccgtgtcagtcagaaccgggcagtccggcaataaagaactgatcgcatatatgagtctgcaggcggacatggatacagaaaaagtgcgttcttcactttctaagcaactgccgaattacatggtcccggcctatatgatggaacttgagaagctgccgcttacgccgaacggtaaattggatcggaaaaatctgcccgaaccggagctcgcgcttcaaaccgcgtacacagctccccgcaatgagcttgaagaacagctttccgtgatctggcaggaagtgctcggcacaaaacaagtcgggattgaggattcattttttgagttgggcggcgattcaatcaaagcgctccaagttgccgcacggctcggacgctatgggtggaaaatgacggcaagtgacttattccggcatccgtccattaaggaactcgcgcctcttatccggaaagcggaaagagtcatcgatcagcaaccggtggaaggagacataccttggacacccgttcagcactggtttttatcacagcggatggaaaacagaaatcatttcaatcagtccgtcatgatgttcagctctgacgcattgcataaacagccgctcaaacaagccttggagcatcttgtcattcatcatgatgcactccggatcaccgtcagtgcagaaaacgaaagtatcagacaaatcaatcacggtattcaaaaagatgaactgtacagcttggacatttgggatctgtctgagacagatacttgggaaagagaaatagaagatgaagtggctgcgctccaacagcggatggatattgaaaaaggaccgttattaaaagccggctggttcaaaacccggtcaggggattatttattcatcaccgtacatcacctggcggttgacggagtgtcatggcgtattctgctggaggatttatctgccgcttacacacaagccgtaaaaggtcagccggtccagcttccgccaaagaccgattcgtttaagcaatacgccgtaaggctttcagaatacgcaaaaagcagcaagctgatgcgtgaagaagaatattggcgttttattgaagaagaaacagccgccggacttccttatgaaaaaccgcagtatcagacgggagccgacagcattcggcaaacggtaagctttacgcttacagaagaagaaacgtccgttttgcttcagcaggtcaaccgggcctaccataccgatacgcaagatgttcttctgactgccgcagctttggctttacgggactggacagggggcggcagactgcgcatcgcgatggaagggcacgggagagagcacatcatgccggagctcgacatcagccgcaccgtaggctggtttacctccatgtacccggtgctcattgacttgaacacagcaggcgctgagcttggaacggctgtaaaaacggtcaaagacacactcggaagaataccggataaaggaataggctacggcattttaaaatacatgacaccgcctgaacaaaaaacaatccgcttcagacaagcgcctgaaatcagttttaactatttagggcaattcaatgatacagaagatcagcccacattcagtttatccggtcttgcgagcgggcacgacatcacgccgacatggcagcgggaacaagcggtggaaatgagcgcgatggccgctcaacataaactgcacttcagtttgagctatccgccgagccgcttccgcaaagaaacgatggaacagctgctgcaaaccttacagcaatatttgcgtgatattatggcgcactgcacaggcaaagaggaagcagaaaaaaccgttagtgattttagcagcaaaacgttaacatctgatgatttggacagcatagcgagttttgtcgaggaactgtagaaaaaggcgacggggagattataacatgacaaaaaagaatgcaattcaggatatttatccgctgtcttatatgcaggaaggaatgctttttcattccctcctgcaaaaggaatcacaggcttacgccgagcaggcctccttttcaataacggggaaggttgacacccgcgtgtttgaagagagcgttcatgcccttttcgaaagacatgatattttcagaacgatctttatcagccagaacgtgtcagtgccgcagcaggtcgtattaaaagagcggaacgtcagcatcattgaggaaaatctcaccaatttaaacaaggctgatcaaatcaagcatattgaagaagccaaacgaagagaccgaaagaaaggatttcacctgcaaaaagacatgctgatgcgggtgacgctgcttcaaaccggtgaatgtgaatatacgtgcatatggagttttcatcacattattatggatggctggtgtctcggaatcgtgctgaaagagttcttccagatatacgcctcgcggctccgccggacaccgttaacgcttgagcccgctgtgccgtacgggacctacatcaagtggctgatggagcaagataaagaaaaagccgcttcgtactgggagcgataccttgaaggctttgagcagcagactgttctgccgaagcagaaaaaagccggcgaaagcagccaagaggaagtgacgttttccttttcaaaagaggacacagctaagctgaaagatctggccgtgaaagaagaggtcacgctgagcaccatttttcacacgctctggggcattttgcttcaggcgtataaccagacagaagatgcggtttttggttctgttatttccggaaggccgtctgaaatcaaaggcatcgagcgaatgatcggcctgttcattaataccgtgcctgtccggatcagcggggcggacattccgtttcaaaagctgatcaaaaacgtgcaaaaggacgctttgaaaggacaggcatacagctatcatccgctttatgatatacaggcgaattcacaggtaaaacaaggcttaattgaccatattctcgtctttgagaattatccggttgaacaggagcttgatgtactgaacagcaagggggacacgaaagacctttttcacatccatgatttcagcatggaagacgaaaccaattacagtttttacctgatggtggcgccgggtgacgagattcacttgaaaatgagatacgattcaagcatgtatgaccgccaatttatcgaaaatatcaaaggtcatttgacacatatcgtttcccagattctcgacaaacctgatatcacgccggataagcttgtaatcatcactcctgaggaaaaagagcagctgcttgcgccgatttctgaagagactgaaaagcctgagtatgacacgattcatgcgatgtttgaacggcaggccgcacaaacgccggatcaaatcgcgatccggtatgaaggcgggtcagtgacgtacaaagagctgaatgaatcggctaataagctggcccgtctgctgcaaaaacgcggattaaagcgggaggagccggtaggcgtcatgctcggccgttctccttctttagcggcggccgttctcggtattttaaaagcgggcggcgcctttgttccgatagatccgggcagtccaaaggagcgtatccgatatgttattgaaaacagcggctgcatccatgttgtaacagagcggcatcagtcactccccgcggaacaaacgctgcaggttacatatatagaagaggccgggacggaagcggacggaagcaatgtgcaatccattaatacggcggacgacctcctttatatgatttatacatccggtacgacagggaaaccgaagggcgtgctgctcgaacataaaaatatggccaaccttctttctgaccaattgacgaacacaggcattgatttttgcacaaatgtgctgcagtacgcatctttggcgtttgacgtctgctatcaggagttattttcagtactcttgagcggcggcaccctttgtatcgtgcccgaatcaatcaaacgggatgtttctcagctgtattcgtttatcgatcagcacaaaacggaagtggtgtttttcccgactgcgtttgtcaagatgcttttcaatgaagaaggttatgcacagtcttttccccgctgtgtgaagcatgtcattacggccggggagcagctgactatctcacgtttgttcaggcagacgctccgtttacacggtatgcagctgcataatcattacggcccgtcagaaacccatgtggtttcaacgtatacgatttctgcgggagatgacatacctgaacatccgccgatcgggaaaccgatccatcataataagatgtatattctcagcaaaaacagacagcttcagcctctcggaattgcgggagaattgtatatttccggagcgaatacaggaagaggctatgtgaacaatccggcgctgaccgaagagaaatttttgccggatccgttcagaaagggcgccgtcatgtaccggaccggagatttggcaagactgcgtgcggacggccaaatggaatacatcggccggacagatgatcaagtgaagatcagagggtaccggattgaaccgaaagaaattgaaaccgttctggcaaatcatcatgccgtgaaagaagctgccgtgctgattcaaacgaatgagtcgggcgaaaatgaattatgcgcctactgcagcgtctcacaagcgactgatccttctcagctgcgaagtgatttggccaaagagctgcctgattatatgattccggtcaaatgggctttcattgacgcgattccgctcactgcgaacggtaaagtcgatcagcgggcccttccggaagcttcggcgtacgcagcgggccgtcgatatacagctccccggaatgtgaccgagctgaagcttacccgcatatgggaagaagtgcttcaaaccggcccgatcggcgttcacgatcactttttcgagcttggcggccattcattaaaggcgacggcactcgttgcaaaaatagctaaagagtgcagcgtgcaaatcccgctgagtgatgtcttcagctatccgactgtagaagaactcgccaaaatcatcggtgaagcagaagagaatccgttcgcatccatagaaaagacagaagcaaaaggaacttatcctgtctcatccgctcaaaaacggatgtatgtccttcaccagcttgaaaatggcggtgtcagctataacattccagccgttttagaggtgaaggggccgtttgaccgagacaggatggaagccgtgttcaaggagctgatccggcggcatgaaccgctcagaacgtcctttgaagaaaaaaacggccggcctgtgcagaggattcatgacgaagtgccgtttgcatttacaaaagaacaatcagccgaagcgtttatccggccgttcgatctcggcaaagcgcctcttttccgggcgggatttgtccaaatagaaaaagaccggcatctgcttttagctgacatgcatcatattatttcagacggcgtatccgtcaatcttttgatacgtgaattcagtgagctgtatgctgagagaagtctgccgccgttacggattcaatacaaagattatgccgtctggcagcaatcatttaaggcgggcgccgcatatcggaaacaagaggagtactggctgaaccggcttgccggggagattcccgtgcttgaattgccggctgataagccgcgtcccccggtgcggagcttttccggtgaccgggtgtcatttgtcatcagcgaaaaacatacagcgcagttgaaaaagctggcgaaagaaaacaaatgcacactttatatgacgctgctcggtgtgtacacggttctgttagcccgtttaagcggacaggaagatatgattgtcgggtctccgattgcaggaaggcctcatgccgaccttgacgccgttctgggcatgtttgtcaatacgctcgctttcaggacgcgtcccgacggaagcatgacgttcaaagaatatttaaaggaaattcgccaaacagcgcttgaggcttacgagcatcaggattacccgttagaagagctcgtcgataagctcggtgtgccgcgggacatgtcccgaaatccgctgtttgacacaacatttgcgctgcaaaatatggaacagcagaagcttagggcagccggacttgaactgcagccggcagacgtcagcctgccgatttctaaatttgacttatcgctgtacatctccgaaaacgccggtgaattgtactgccagtttgaatacagcactgatttgtttgagagaaaaacgattcaaaaatgggcggaatttttcacgacacttgctgaaaacgccgcagctgatccgggtttggaattagacgatatttctgttttgtcagaaaaagaagaagtgtctctgcttcaaaatttcagccccttgcagaaaacagcgtttccgcttcatcagccccttcatgagctgctggaacaacaggcggaaaaaacgccggaccgtccggcgattttaactgatgagatttcgattacgtatcaggaactgaacgaaagagcgaatgagcttgcgcaccggctgatcaaacgggggataaggctggaggataaaactgccattatgggccggcgttctcctgacatgctgatcggcatttacgctgtcttaaaagcaggcggtgcatatctgccgattgatccggattacccggaagagcggattcgctttttactgaaagacagcggcgtgaaattcttactggcagaaccagaacttttcgcaccagatctttttaagggagaaacgatctctctgaaaagcggacaaacaggaaacccggaagctgcggccaaccccaatgttccggtaaagcctgattcattggcttatatcatctatacatccggttctacgggacgcccaaaaggcgtgcaggttgaacatcagtcagccgtaaactttttatactcgctgcaagcgcgttatggattaaaggattccgacaccattttgcataaaacatcatactctttcgatgcttcgatttgggagctgttttggtggccgatcgcgggagcttctgtttttctccttccgcaaggcggcgagaaagaccctgaaatgatactgaacgcattggagaaaaaccgcatcacggcagctcattttgtgccatccatgcttcatgctttcttggaatatataaattccagaaaacagccgatcaaaaagacctgcttaaaaagggtttttgccgggggcgaacaattgggcccgcacttggtttcccgtttttatgaccttctgccgggaacggaattgacaaattcctacggtccgacggaagcgacggtagaagcggcgtacttcgatttgccgcaaggaaaggaatttcacaatgttccgatcggcagttccggacataacatgcggctgtatattttaaatcaaaagaaacagcttctgccgccgggctgtatcggagagctgtatatcgcagggaccggcgtggcccggggctatctgaaccgccctgagctgacggaggagcgctttgtcgttgatccgttttatccgggagaacgcatgtatcagacgggcgatatcgcacgctggacagaagacggccttgtcgaatggctcgggcgttcagacggacaggtgaaagtccgcggctaccggattgaaccgggggaaatcgaagcggcgatccggcgcatcgacggcattcgtgaggcggcggtcaccgcccggaccgaacacggcgaaaccgcgctttacgcctatatcgaaggacgaaaaagcgatgacgtgcgggcagagcttgcggcacgccttccggcctacatgatgccggctcagtttatagagatgagcgaatggccggtcacgccgagcggaaagcttgaccgccgcgcgctgccggctcccggcggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagagagcccgtatgaagcgattcagcctgcgaaaaaacaggacacctacccggtgtcttcagcgcagaaacggatgtatgtgctccaacagcttgaagacggcggtgtcggctacaatatgccggctgtgctggaactgacgggcacgcttgaccgtgtccggctggaggagacgttccgggagcttgtggagcggcacgagtcgctcagaacgtcctttgaaacggggcctgacggcgaaccggtgcagcgcatccatgacagcgtaccgtttcagctcgatgaggccgagtcagctgacgcattcgtccggccgttttgtctggaagaagcgccgctcttccgtgcggctctcgtgaaagaatcggatgaacgccatcttttattaacggatatgcatcatataatttctgacggtgtgtccgtcaacaccttgattaaagaattcggcgagctgtacgcaggccgttcgcttgcgccgatgcgccttcaatataaagactatgccgtctggcagcggtcgtttcaggagaaagaagggtaccagaagcaggaagcctattggctgaagcgacttgaaggagagcttccggtgcttgagcttccggctgacaagccccgtccggcggtcagaagctttgcgggcgggaaagtatcgtgcacgcttgacgctgaaacggcatccggccttcaccgcatcgcccgggatcacggctccactttgtatatggtgcttctcgccgcgtacaatacgttactcgcgagattgagcgggcaggaagacatcatcgtcggatcgccgattgccgggcgcccgcacaaagaccttgaaccgattctcggcatgttcgtcaacacgcttgccatcagaacggagccgaaaggagacaaacggtttaccgattatttggcggaagtccgccaggcggcgcttgaggcgtatgagcatcaggactacccgtttgaagagcttgtggaacggctcggcgtgcagcgggacatgagccgtaatccgctatttgatgccatgcttgtcgttcagaatatggaacatgaggaattgctgttggacggtttgcatattcagcctgcggacgtgtcccgtccggtttccaaatttgatgtcactttgcaggcttctgaaggcgggggacagattcattttctgtttgaatatgcggcgtctttattccggaaagaaacgatgcagcgctgggcttcccactttatgacgatgcttgaacacattgtccgtgaaccggaaacttctatacaagcgatcagcatgctgactgctgcggaacgggaccgaattctttcggactttaacggcatgacggataaacagctgcctgaaaaaacagttcatgaactgttcatcactcaggcgcgaaaaacaccggatgcggcagcccttatcagcggggaaacgttggtcacatataaagaattagatgaatggtcgaataaaatcgccagagctctgcaaaaacggcagatcggaccgaatgccgccgtcggcattgtgataccaagatcaccggaacaagtcgccgcagtcttcggggtttggaaagccgggggcgcctacgttccgatagatcctgaatacccggaggaacgcaagcaatatatcatttcagacagcggcacagcgcttctccttaccgtacacggcgcaatagatcaagtgcctgatcattttaaaggtgaagtgctcgcactggaggatatccaagaacaagacgcatcaccggttcagccattatcagcaccggaagatttggcttacatcatttacacgtccgggacgacaggcaggccgaaaggggttatggtcgaacatcgttccgtcagccaaacccttcaatggcgaagcggattttatgatctgaatgagaaagatacggttcttcagcttttttcattttcatttgacggttttgtaacaagtatgttcacaccgctgatttccggtgcgaaagcggccgttttagccgaagatgaagcaagagatattcttgccattaaacactatcttgcatcttaccgcatcactcatatgatcattgttcccgtactgtaccgtacactgcttgacgtactggagccgggggatgcagagtctctcagaattgtcacattagctggagaagctgtcgaccaaaacattatcagccgcagtttatcagtttgtcctcacacggagcttgccaatgagtacggcccgacggaaaacagcgtcgccactacagcggcaagacatatagaacaaagtgagaacattacgatcggccggacgattgagcattcacacgtttatattttaaacggggatcacccgcagccgatcggtgtaacgggagaactttgcatttcgggttccggccttgcaagagggtaccgcaatcttcctaagcaaacggcccaagcctttgtccaagacccgttccagaagaaccggcgcatgtaccgcacaggcgatctggcaaaatggctgccggacggcacgctgcaatatatcggccgaatggacgagcaagtcaaaatcagaggctaccgggtggaactgaaagaaattgaatcggccttaacaggcataaaaggtgtcaaagaagcagccgtcaccgctcataccgcatcagcaggccaaacggaactatgcgcttatatcgtgacagaagaaggaacagaaagtgaaaccgtgcagcaggcgctcagaaatgaaatgcccgcttatatggtgccggcgttctttgaaacacttgaagccctgcctgtcacaccgaacgggaagcttgaccgccgcgcgcttcctgagccgcggaaaaaagcgcacaccggacgggcatttacggagcctgaaagcgacatggaaaaagagctttccgcgatttggagcgaagtgctcggaactgaaaacattgccgcggatcaatcattttttgaactgggcggcgattccatcaaagccctgcaagtatcagcccgattacatcaggcaggaaaacagatcgccgtaaaagatattttcagccggccgacaattagagagctggcgccttatgtccgtacagagcggcagccggtcagccaagctcctgcagaaggagaagtgaagtggtcgccggttcacaaatggttcttcacacaagacatgaaggaagcaaatcattttaaccagtccgtcatgctgacgagaacaaattcaatagatgaagaggctctcaggaaaacgttaaaagccattaccgttcatcatgatgctttgcgccttgtctgcaaaaaagacgaagagaaaggtcttctcctcttcaacagaccggctgacctcgcagatgagcagctttacaacctgaccatattagaaacggaaggcgatgagcatgagaaggaacgttttataaaacgccgcgtcgcagagcttcagagaaacatggatttggagaacgggccgctggtacaggcgggactgttccgctctgaagcagaagattacttgtttctgacggtccatcatctcgctgtcgacgggatatcatggcggattttattggaggacttggcttctgcttatgagcaggccgcctctggacaggaaatcaaactccctccgaaaaccatgtcattcaaaacatatacggagcagctggccgattatgccgaaagcaaacagcttcttcagcaggcggagtattggcgggagattgaacactatgaaacagaaagtcttccttacgagcaggcagatctatctcaaactcctgcaaaaaaacggaacacggtatccttcactctgacagaaagtgaaacggacgccctgttgaaagatgtgcacagcgcctacaatacggatacgcaagatgtgctgttggcttccgccgtgcttgcccttcaaaagtggtcgccgcagcacgctttgaaaatcgcccttgaaggacacggacgccaatcggagcaggcaggtgcggacatcagcaggacagtggggtggttcacttccatttacccggtgcttgtccggagcggagtttatgaacctcttgaagaatatgaaattcgcacattgaaaaccgttaaagacacattgcggcgcattccggataaagggaacggatacggcgtcctcaaatatttaacaccgccgaagcttgccgggatgactttcgggaaagcaccggagatcagctttaattatctcggacaattcgatgcgcccggcgggagtccggcagaaacggaacagcctgacgcgtttcagttttctcctttgggaggcggagatgatgtcacagatacatggaaacgggagcagtcacttgaaatcagcgctattgcggcaaaaggccggatgaccgtcagcatttcctatgaaacggagcgcttccggcaagatacgatcgaacggctgtccgaaagctgccggtattatctcctgaaactgtcggaacactgcctcagcaaaaccgatacggagaagaccgtcagtgactttgatgatcgggagctgactgaggaagccttgcaggatattgccgacttactcagcttccactaaaccgagcgggaggaacacatggacaaaacaaaaaacatccaaaatatttatcccctcagccgaatgcaggaaggaatgctttttcattcctttctgcaaaaggagggggctgcatatatcgagcaatccgtcttcaccataaaaggccggcttcgtccggaattgtttgagcaaagcgtacagtctgtcatcagccgtcacgatattttcagaacggtttttttacctcatgtcgctcagctgaacggcccccgccaagtcgtgctgcgtgagcgggaattccggctgcaccgcgaagatcttacacatttggatgaagcggaacagagcgcctacttacagcgatttaaggaacgtgaccgcttaaaaggctttgacttgcaaaaggatatgctgatgcgtgtgtctttgtttaaaacggctgaggaaaaatatgtatgcgtctggagccaccatcacatccttatggacggctggtgcctcggcatcgtccttcaggaattcatgcatatgtaccgggcgattgaatcaggctcacccgtcacactggcgcccgcaaagccttacagcacgtatattacatggctgactgatcaggacaaagacgcggcttctgagtattggaaaggatatttagcaagctgcgagacaccctcaggactcccgaaaatatcggcccgtccccagggaaaaggctaccgtaagaaagagctcctgttttctttagatcaaaatctgacagacaggctgaaaaccatcgccaaagaagagggcgctacgctcgcggttcttatgcagactgtatggggcctgatgctgcagcgctacaaccggacggacgatgccgtattcggcgccgtcgtatcagggcggccttccgtcattgacggcgtggaaagcatgatcgggctgtttatcaatactgtgccggtacgcattaaaacgggtgacgaaagctttagagaactgctgggccgctgccagaaagaaatgcttgattcagaggcgttcagttatcatccgcttgctgacatccaatctcagactgagctgaaacaggatttaatcgaccatatcatcgtgtttgaaaattatccgattcagcagcagatgagagacgcggaaaaggaatcggatgcaccgttccggatcgggaatgtcaatgtttcggaacaatcgggctacgattttaacctcatcatagcgcccggcgatgagctgatcatcaaattcagctacaatgcgaacgtttatgacgaagtatggatagagagcgtaaaaggacacttggaagaagcgctgcgcggcgccgccttcaatcccgatgttcccgctgatcggcttccgatgctcggacaaaaggaaaaatcaagaataatcggcgaatttaatgacacgaaaacaacgtatgaaagagacgaaagcatcatcagcctgttcagccgacaggtgaagaaaaccccggaccatcaggcgcttcacgccggcgggctgacgatgacgtaccgggagctcgatgaacggtcaactgcgttcgcccgcatcctgctggaaaacggtttggcgccaaaaggaattgccgggattcttgccgaacgctcaccggaatttatcatcgctgttctcgctgtattgaaagcgggagggacgtaccttccgctcgatgcagaactgccatccgacaggatcgccgaaatgctcactgagagcggagcacagctgttaacggtacaaaaagggattgagactgacattgacttttctcacatcatctctatcccggctgcagctgaaaaacaaacagctgatgagggaaaactgaataccgttacgtcacctgatgaccttgcctatattatgtatacatccggttcaacaggaaaaccgaagggtgtgatgatttccaaccgcaacgtcgtatcgctcgtgtcaaacagcaattacacgtcagccggcacgacggaccgtctcattctgacaggatccatcggttttgacgcagtgacgtttgaaatcttcggagcgctattgaacggagcgtgcctccatgtggttgaccgcacgacaatgcttgcccctgagaggttcggcaattatctttcttccaacggtattacgattctgtttttgacgacggcgctttttaaccagtttgcccaggcggatccggagatgttttgcggattgcacaccttatatgtcggcggagaagcattgtccccggcgctcatcaataaggtcagacaccgctgtccgaatctcagcctttataacatatacggaccgacggaaaatacgacattttctaccttttacgaaatcaggcacgatttttctcagccgatcccaatcggaaaaccgatcagcaattcaaccgcgtatatcattgataaaaatggcggacttgcgccgatcggcgtgcctggtgagctttgtgtcggcggggacggggttgccaaaggctatttaaacaggcctgacttaacaagtgaagcatttgtcagccacccggttcatcctgaagaaaagatctacagaacaggggatttggcacactggctgcctgatggaagcatcggatacatcagccgtatcgaccgtcaattcaagattcgcgggaagcgtatcgagccggccgaaatcgaagcgcggctgactgaaattgatggaatcagggaagcggcagtcatcgtgtcagacgaaggacaagaagcaaccctttgtgcgtattatacaggcgcacatgctgaagaaagagccattcgatccctattggccaggtcgcttcccgactatatgattccgcagtatgtgatgaagcttgaccgtatgccgcttaccgcaaacggcaaagtggaccgccgcgggctgcctgcgccggaacggaaaaaagcttcatcaaaagccgttccgccacgaaactgggtagagcgtgagctgatcgacatttggacgccgatcctcggctgcggggagctgggcatacaggatgacttctttgagctgggcggccattctttgaaagcattgcaagtgattcatcagctgaagaccaggcagcagatggacgtcccgattgaaatgatatttgaatatccgacaattgaacaattggctgaaaagctgtattcaaacacactgtcagaagctgccgaacagcatatcagcagactgaatcagccgaaaggccgcaatcttttctgttttccgcctatctcaggtttcggcattttctttaaagatctggcggcggcattaaatggacgggctgctgtgtacggttttaactttattgaagaagacagcagaatggaacaatacattgataaaatgctggaaatccagccggaaggcccttatatcctcttcggatattcagcgggcggcaatacggcattcgaggctgcaaaagcgatggaaaagcgcggcttagaaatcagcgacgtcattatcgcagacgcgtacagaaagcttgacgcactgccgccgcagccaacaaacgcaacagccgaaaatgtcccggaagccgtcagggaagcggtcatcagaaaaacagagcgctatcaaacgtactgggcggaactgataaatgacggccaaattgcggcaaatctccattttattgaggccggcataaaggaagagcacagtgataagaccgagccgatgaaatgggaaggcgccacaacgggagtctaccaggaatatcagggcgagggagcccataaagatatgtttgagcccgagtttgcacacaaaaatgccgaggtcatactggacatcatcgcaaacagcggaagacgcttggcgcggaatctgtaacatccggcagaatgactgaagaagacaaagggcaagataggggaatcacactcagtttttttggaggctttgagatgacgaacctatcttggcttacgtatgtaatgattattcttgccagctaccggctgacccatttgatcgtatttgataagattacggaattcataagaaaaccctttataaagcaagaaaaaaccgtcgatcaaaacgggcgcgccgtccaaaaaaaagtcccttcctccgcattcggttatatgctgcaatgttattggtgtgcgggcgtctggtgcgccatattgatcggcatctgctatttggtctggccccgctatgcacatccggttattttcattttgtccattgccggagcgcaggccattcttgaaacatgcgtcggcgtcggaacgaaggtcattgacgtgctcgccgccataaaacataaaaagtcctgaagcgttttgattcgctttaggacttttttctttcccttttaggctgagaggagcaaagcaggctttctgattcaccgcccggaatgcttcggaataccgtaaagcagagagggggaaaaacatgaaaagctgccgttttagcatgatatggtttttggccgttgtactgacagccggcatctttacgttctcagcatccgcacaagcaagcggcactcagccggagagagaaatgcgagccgtatggatcgcgtctgtcaccaatatcgactggccctctaaaaaagggctgtcaccggaagagcaaaaaagagaatacagcaagctgctggatgacgttcagaagatgggaatgaacgccgttatcgtccaaattaagcctgcggctgatgctttttatccatcagattacgggccttggtcagagtatctgacaggaacccaaggcaaaaatcccggctacgatccgcttgcttttttagttgaagagacacataaacggaatcttgaatttcacgcttggttcaatccttaccggatcacgatgaatcacacaaatttgaatgcgctttcagatgatcatcccgcgcgttcccatccggactgggtcgctgcatacggaaaacagctgtactataatccgggcattccggaagtaagacaatttataacggatggaatcaaagaagtggtcagccgttatgacattgatgcggttcatatggatgattatttttatccttataaaattgccggacaggaattccccgatcaggcggaatacgaacggtacggaaaagctcactttgcatcgattgatgactggcgcagggataacgtcaaccggcttgtaaaagaaatcaacgaaaccatcaaacgagaaaaaccttatgtcaaattcggaatcagcccgttcggcgtatggagaaatgccgcagatgatccgacaggctccgaaacggccgccggggtgcggaactacgatgacttatatgctgatacaagagaatggatccaaaaaggatacattgattacatcgcaccgcaaatttactggagtatcggatttaaagcggcggcatatgacgtcttagcggattggtggggaaaagaagtgaacaatcggccggtgcatttatatatcgggcaggcagcttataaaatcaacaacaatactgatccggcctgggccgacccgggggaatacggaagacagattacgctaaacagaggatcagcatggataaaaggcagcatgcatttcagtttaaaggatttaaaccgtaatccgctcgatgtgaaaaaccgtttgatcaatgacatgtacagccggcccgcattaattcccgagatgccttggctcggacattccgctttaaaaaaaccggctgtcaaacgggcggagaagaacgcttcaggccatacactctatatcgaagatgcgaaatccaacggtaaaaaaacggcttattacgccatttaccgcgcagaaaagggaaagcagccttatttagtggatacagtcagaaaaacatcgtcacggacgcagacattttcagatactgttattcgggcggaagaagcatgcacctatatcgttacttccgttgacaggcttcaccatgagagccgtccctccgcaaaacggacgattaaatagccattattaataaaactgacagttgcggcactgtcagtttttttttgcggcggatgagtccgaatgttcagactttatttggatggaatgaataaagacccccattaataaaatgtagaaagcagcagaaggaggaaggttaatgaattttcaactgacaaaagaacagcagatggtgcgcgaaatggtcagagatttcgccaaaaatgaaattgccccgaaagcccatgaggttgatcaatcagccgtcttcccgatagacacatttaaaaaaataggcgaactcgggctgctcggaattccgtttccggaagaatacggcggggcgggcggtgacaccatttcatatgcagcagcggtcgaagaaatcggaaaagcctgcggcagcacggggctgagctacgcggcagccgtgtcactcggcgcaagcccattatactatttcggtactgaacagcaaaagcaagaacatcttgttccgcttgcttcgggaaaagcgctcggatcattcgggctgacagagccgaatgccggttcagatgccggcggcacccagacaaaagccgagaaaaagggcgatgactatgtgataaacggagaaaaatgctggatcacaaacgcaaattacgcccgcacggtcattgtcaccgccgttacgggaaagaactccgccggaaaaccgatcatttcagctctcatcgtcccgacagacacaccgggatttacgatcacaaatccgtacgacaagatgggtgtgagaggatcggatacggccgagcttgtgctggaggatgtcagggtgcctgccgataacctgctcggtgatcctgaaaaaggttttaaacaatttttatatacattagacggcgggcggatctcgattgcggcactggctgtcggtatcgctcaaggcgcactggaggcgtcgctgtcatatgcgaaggaacgcaagcagttcggcagtccgatatcgtcatttcaagccattcaatttaagctggccgatatggcgatggaaattgaccttgccagacaaatggtgcttaaagcggcatggctgaaggatcaaaacctgccatttacgaaagaagcggcattcgccaagctttatgcttcagaaatggccgtcagaacctgccttcaggccatccaaattcatggcggttccggttatatgaaggaatgcggtgtcgaacgtatgcttcgtgacgcaaagctgatggagattggagaaggaacatcagaaattcaaagaatggtcatcgcaagacagcttttgaagtgaaatgaaaacgtttactaagacagggatggaagggggcaggtcatatggctgaacttatccatttaacagccggaaagctgcttgagcggaccgcggagctttttccggatcatgaagcggttgtttaccctgagcgcggccttcgttatacgtatgccgagtttgaccggttatgccggcaaaccgcaaaagggctgatgaaactgggaattgaaaaaggagatcatgtggccatatgggcatccaacataccggaatggctcgcggcgcaatttgcaacggcgaaaatcggcgctgttctggtcaccattaatacaaattttcaaatcgcagaactcgattacctgctggcgcattcagacgtctcggccctgataatcatggattcctaccggcagacatcttatgttgagatggtgaataagctgattccggagctgaaaacttgtgagcacggcaggctgcgttcgaaacgttacccctttttacggacggtgttatatatcggtgataaaagtccgcccgggatgcaccgctgggattctttgctgaaggaaggcgaagctgtaacggatgcagcgcttgacggaaggatggacagcctgaaaaaggatgattgcattcatatgcaatatacatcaggtacgaccggatttccgaaaggcgtcatgctctcacattttaatatcgtaaataacgcggccaatatcgcagaatgcatgaagcttacttcaagtgaccgtttatgtattcccgtgccgtttttccactgcttcgggtgtgtgcttggcgtgctggcatgtgtttccgcgggtgcggcgatgattccgatcgaacagttttctccaccggccgttctgaaaacggtggagcaagaagcctgcacggctctgcacggtgtaccgacgatgtttatcgccctcctaaatgacagccgcttttctgaatatgatctttcccacgtccgaaccgggattatggcaggctcgccatgcccggcggaagtcatgagagaagtgatcggcaaaatggggatgaccggcattaccattgcctacggacagaccgaagcatcacctgtcattacgcagacaagaacggatgattcatttgaaagaagagtggaaacagcggggcgcgcgcttccccatatcgaagtcagaatcgttcggcccggaacatcccaagaagccgaccggggcgaacaaggagagctctgcacccgcggatatcatgtcatgaaaggttactataaaaatcaagaagcgaccgaagaagcgatagacaaggacggctggctgcataccggtgatttggctgtcatggacgaggacgggtactgcaaaatcacgggccgtctgaaagacatgctgatcaggggcggcgaaaatatctatccgcgcgagattgaggaaatgttatatcggcatcccgcagtggcagacgttcaggtcgtcggcgtgcctgatccgaaatacggagaagaggccgcggcgtgggtcaggctcaaagacggacaaaccgcttccgcagaagacatcagaaccttttgcaaagaacatatcgcccgctataaagtcccaggtatgttttgtttacagatgaatatccaatgacagcctcaggaaaaattcagaaattcaagctgcgggaaaaaacgattgaagagctcaagttaacttaatgaaaaaggagtgcttcacatttgtttaaaaaagtcctgattgccaacagaggagaaatcgccttaagaattatccgcacctgcaaacgtctcggcatcccctcggcagctgtgtattcagaagccgacagggacgcgctgcatgtaaaagcggctgatgaggcctatccgatcggtaaatcgagagtaaatgaaagctatttacatatcgacagaatcatagaagccgccaaatccgccggagcggacgccattcatccgggctacgggctgctgtcagaaaacagcctgttcgccgaacgctgccggaaggaacaaatcacatttatcggcccgcccggtgatatcatcgccaagatgggcagcaagatagaagcccgaaaaacgatgcaaaaagcaaaggtcccgatcgttcccggtgtttcagagccattgcccgatgttcactccgccttagccgaagcccgtgccatcggctttccggttatgctgaaagcgtctgcagggggaggcggaatcggcatgcagatcgtacattcagaagaagagctggccaaagcgttcgaaggcaatcaaaagcgggccgcgtccttttttggagacggcgcaatgtatatggaaaaggtcattgaaaatgcccgtcatattgaaattcagattctcgcagattctttcggcaacaccgttcatctgtttgaacgtgactgttcagtacaaaggcgccaccaaaaagtgatagaagaagcgccgtcgccgtttgttgacgatgaattaagacaaagactcggtgaaaccgccgttaaagccgctaaatcgatcggctaccaaaatgcaggcacaatagaatttctcgtcgaccaaaagaaacaaatctattttttagagatgaacacaagactgcaggtggagcatccggtgacagaagaaattacaggactggatcttgtggaagaacagctgaaaatcgccgccgggcaggcgctgactttctcgcagaaagatatcaaccaccgcggtcatgcgatagaagtgcggatctatgcggaagatccggtcaccttttacccgtcacccggtaccatctcgtctttttccgttttaagacacccgtcagtgcgacacgaatgcgccgtcgaaaagggaagcgtcatttctccgttttacgatccgatgattgccaaaatgatcgtcacggcgaatacgagaaaacaagccattgaacaactgaaaaccgcccttggcgaatatcatgtagaagggattaaaaccaacattccgctgcttacaaaaattgcacattcagaagtgtttgaaaagggtgaggcaacaaccggttttttacaaacaatgaacgagggggcgtcaaaatgagcgtcataaaaattcagatggcgggaaacctgtggaaaattcatgtgaagcccggtgatgtcattgaagaaggacaggaagtggccatcttggaatctatgaaaatggaaattccgattatcgctgatgcagcgggtacggtgaaagaagtgaaaaaatcagaaggtgatttcactgatgaaggagaggtcctgattgaacttcaataaaacgggaggtgcagcatgaactgtccggaatatgtccgcatcaatgaagtaggaccgcgtgacggcttgcagaatgaatcggcgtgggtggatacagaagataagattgagtggatcaatatgctgtcaaaaacaggccttccctatatcgaagtgacatcattcgtgcatccgagatggattccggctcttcgtgacagcctggacgtcgcaaaaggcattgccaggtctgaacatacggtctacgcggcgctcgttccgaacctcatcggactggagcatgcggcagaaggcggaatcgatcaggcctgtgtatttttatctgcaagcgaaacccataaccaaaaaaacgtaaacaaaccgattgaccggaccgttcaagagctcaggcgggttattactgaagcaaaagctgaaaaaatggcgacgagagcttatctgtccactgtgttcggctgtccgtacgaacagaacgtgccggtcgaacaagtcatccgcctgtcagacacactgctcgaaatgggtgttgatgaaatatcgctcggcgacacgatcggcgcggcaaaccccttgcaggtcatatccgtgcttgaagcccttttgccgagaattcccgcctcaaaaatcgcactccatttccatgatacaagaggaacggctctagcgaatatcattcccgctcttgatatggggattacatccttcgatacttcctcaggcgggcttggcggctgcccgtacgcccctggatcagcaggcaacgctgccacagaagacgtcatttatatgctcgaacaaatggggattgataccgggacggacatgaataaacttcttgatgccgcccgctggatcgcggataaaataggcaaagatctgccaagcagaaatctgcaggcattcagaacgaaatgagaaaggagaagccatgggagattgcgtcttgtattccgtctgtcaagaaacgatcggtctgatcacgctgaaccgcccgcatgcggccaactcgctgtcttcagaaatgattgatcatttacagcgtgtgattgaagacatcaaaaactcgccatccattcgctgtgttattctcaccggctccggaaacacattttgcgccggcgctgatttaaaagaaagagctgggatgaatcatgaacaagttaagcaaagcgtcaggcgtatcggtgaaacggctgcatccattgaagctctcccgcagccggtcattgcagcgctgaacggaaccgctgtcggaggaggccttgaactcgctctcgcctgcgatatcagaacagccgtcagccgggcgggcctcggccttcctgaaacagggcttgcaatcattcccggggcgggcggaacgcagagactgccccggcttatcggccccggcgcggcaaaagaattgatctataccggccgaaggctttctgccgaagagggaaaagacatgaagctgatcgagcatgtttgtgaagccgatgaacttatggaaaaagcaaaagcactggccggccgcatcgccgctaatgggccgatcgccgtcagacaagcaaaatccgcgataaacaagggtctggagacagatctcaatacagggctcgaaatcgaacgaaaagcatatgaacaagtcatccctacacttgacagagaagagggcctgcgcgcttttaaagaaaaaagacccctgaatacaaaggaaaataaaacatggagggactcggatggattacgaaaaagaacggcagacacgcagcaaaacgattgaaaagggaggagccgcgaaatatcatgcaagcaacgaaaagaagggaaaactttttgtaagagacaggctgaagcttttattcgatgacggcatatccgttgaagacgcttttttcgccgagtgcatgtcagacggactgccggctgacggggtcgttaccgggatcggaaccatcggcggcagaaccgtttgtgtgatggcaaacgactcaaccgtaaaggcgggctcgtggggcgcgaaaacggtggaaaaaatcatccgcattcaggagacggcggagaagcttcagtgtccgctcttgtacttagtcgattccgcaggtgcgagaattacggatcaggtcgacatgttcccgggcagaaggggagccggccgcatcttttataatcaagtaaagctgtcgggccgcattccgcaaatctgtttattgttcggtccttccgctgcgggcggcgcttacattccggccttttgcgacattgtcattatggtcgaaggcaatgcatccatgtacttaggttccccgcgcatggcagaaatggtgatcggcgagaaagtatcgcttgaagaaatgggcggcgcccgtatgcattgttctgtatcaggctgcggtgatctcctcgccccgacggaacaggaagcaatcatgatggcgcagacatatctcagctactttccggcaaattatactgaaaaagcgcccgtcaacaaatctaagaacccgaaagcttttgaaaaaccgctctcagatgtcatcccggcacatcaaaacgcaccgttcaacatgatggatttaattgaacgtgtcattgatgaagactcgttttttgagattaaaccgttatttgcgcaggaattaataacggggctcgcgcggattcacggacagccggtcggcattatcgccaatcagccgcgtgtcaaaggcggagttttatttctcgattcggcggataaagccgcaaaatttatcgctttgtgcgacgcattccatattccgcttctgtttttagcagacattcccggattcatgatcggaacgaaggtggagcaggcgggcatcatcaggcatggcgcaaaaatgatctccgcaatggcggaagcgactgttccgaagctttccgttatcgtcagaaaagcctacggtgccggattatacgcgatggcggggcctgcttttgaaccggactgctgtttagcgcttccgactgcgcaaattgccgtaatgggtcctgaagcagcggtgaatgcggtctacgcaaacaaaatcagcgagctggcccctgaagaaaggccggcttttattcaagaaaagcgtgatgaatataaggaagacattaacctttaccggcttgcctctgaaatggtgattgacggcattgttcctgctgattccttgcgggaagaactcaataaacgcctcactgcttacatgtccaaacaactgacattcacacaccggaaacaccccgtatacccggtataaataaaaaaagactgcatagatccggctcgcagccgttcttatgcagtcttttttcacagtcttgatctcattttcttcacaacaaaataaacaacaataaatacgagagccaatataatgatcggagttgtatacattccggcatagctgtctacgtctttccactgtcccccgagctgatacccgagataaacgaaaatgacagaccacggaataatggcaagcgtcgtcaatatgacaaacttggaaagaggcattttcgcaaggccggccgggatggaaatcgcatgtctgacgaccgggataaaccgcgccgagaacacaacgccggcgccgtaacggcgaaaccagttttccgcaacatcaacatgatgctttttcagaagtaagtacttgccgtacttgtccaaaaacggccgtcccccataacgggcgatccagtatataaagcactgcgcgatcgttcccccgatcacaccggcgacaatggcgccgataaagctgatcgtgccttctgacaccatatagcctccgtaagccagaacgatttcactcggaatgatttcgatcattaatccgagcgcaatccctaaatagcccatacttgtcagccaggataatatttcactaataaaattgcccacactgttcacaacctctttatctttttacccaattatatgactgattgacaagcaaaatggttacaaattattttttaacgcacgatttcttcagattctctttttaacacctcttctaaataagctaaaagtttcggtctcatttcttcccgcagaagcccgatctccgtgccggccttaaaacagccgaacttatctcctatatcaaaccggcttccttcaagctcccgcgcgtaaatgcttcgggtgcggcatacttcgcgcagcgcgtctgtcaattggatttcgctgcccgcgcctcttccgatcgtcttcagcgctttaaaaatggcaggggttaatatgtaacggcccaacacggcaatatgagagggcgccttttcaacggccggtttctcaatcagatcctcaacccggtacacatgaccgctctgccgccccgtctgtataataccatatttgctgacatcagcaggatcgacgggctgtacgccgatcgtttctgtgccgtgttggttatagacgtctatgagctgtgaaagagcgggagtgtcagataccataatatcatcacctaatagaacggcaaaaggctcatctccgataaaatgctccgcacacagcaccgcatggcctagtccgagcggttctttctgacggatgtaatgaatattggccaaatcggcaatccgctgcatttccttcagtgtctctgacttgcctttttccttaagattgatttccaactccgccgaccggtcaaaatgatcttcaatcgagcgtttgtttctccctgtaataatcagtatatcttcaattcctgactctcttgcttcttcgacaatgtactggatggccggtttgtcgacgatcggcagcatttctttcggctgcgcctttgtcgccggcagaaatctcgttcctaaacccgctgcggggatgaccgcttttctcactttttttctcattcatcttcactcctgatcctgtatgtttttcagcgaatctccaaatacccagattcggtttccgataaaattcatcatcattccgccgatagtggcggcgagcttactcaccaaaagcgaacagccgcctttttgaaacgcgtacagcagcaaaaaggtgattcccgacgctgcaagattaatgatgagaaagcgcacgatctctttcccgtcagccttgtgttttacacgaaacgtccacttccggttccacacatagctgttgatgatccctgccgaataggagcagatctgcgccggcagataggggacaaggcaagcggtgagaagaaagaagacaccaaaatcgatcagcgtattgccggcgcccacggtgcaaaaacggcctgctgtctttactttttctttcagcataacggcatccggttttgacctcccttcataagtaagatgcggatcgctgtcctatttgttgatatggattactttagcggacagtgttgaataaacaattactaaaatatgaacaaaacatgaaaacgtaatgaggctttgtaaaacccattaagttaacagttttatattttaggttgacatattacgtgcaagacactaatattctgtattagtgttaaccttttattattttggttaacattaaatttcgaaataaaagaaaggagggaaatttcatgcaggaagagacctattacagcgtcagaatgagagcttcccgaaacgcccccatgagcagggcggaaaacatatttccggcggagaacggctcatcacttacagcggtttacaggaagcggtagatggcttattacataaaggcttctcacactcaagagggatacctgattttatgcagattcagcttgaaagcgttcatgaaccgatcgaaacgatccgccctttgccggttgccctccatcaaacagacacgccggaaaaaggacaagcaatcgcccgcaagcttctgcaaaaggcggggattcctccgcacatgatcgagaaagcgtacgaaaacatttcggaatatgcagaagcaagaggagcggtcctgtttgatatccgggcaggaaaacgcattgactgcagagggaatagaggtgtgcgggtatcccgagtggattggccgtcacctgattttcaaaaatgggcttttactcacaacatgccggaaaattcacgaataaaagaagcacatgccatcgcggcaaaagtttgcgcacatccgggaattattgccgaattgtgctggtcagatgaccctgattacataacaggttacgttgctgcaaagaagctgggatatcagcggattgccaagatgaagaatgccggagatgaaagcggatgccgggttttctttactgatggctccatagatacggagagctgtatccattttttagagaagcagcctgtattcattcagcgggaggagaacatatgaaacaatcaatgattgaaaaaagcaaacagcatctttggctgcctttcacacaaatgaaagattacgatgaagatccgttcatcattgaaagcggaaacgggatcatgctgaaagacatcagcggaaaagaatattatgacggcttttcttcagtatggctcaatgtacacggccaccgcaaaaaagaaatggatgaagcgattcaaaaacagcttgaaaaaatcgctcattcgactttgctgggtatgacgaacgttcccgcaacagaacttgccgagatgctgacgggcatcacaccggaaaagctgacgcgcgttttttattccgacagcggagcggaagcaatggaaatcgctctgaaaatggcctttcaatactggaaaaacgtagggagacctaagaagcagacgtttatttcgatgcagaacggctatcacggcgatacaatcggagccgtcagcgtcggctccattgaactcttccaccatgtgtacggcccgctgatgtttgaaagctacaaagccccgattccttatgtatacagatctgaaagcggtgaccccgtacagtgccgggatgaatgccttcacgcgctcgaacagctgcttgcaaagcaccacgaagagattgccgcacttacgattgaatcgatggtgcaaggcgcatccgggatgatcgtcatgcctgaaggctttctggcaggcgtacgaaagctgtgtacggcatatgatgtgttaatgatcgttgacgaagtggcgacggggttcggccgcaccggaaaaatgtttgcctgtgagcatgaaaacgtccagccggacttgatggcggcagggaaaggcattacgggaggctatttgccgatcgctgtgacgtttgccacagaagccatttatgaagccttctacgatgactacgacaaaatgaaaacatttttccacggccattcctatacaggaaatcagcttggctgtgccgcggcaattgaaaatctgcgtttattcgaatcagagcgcatcgttgaacgagtcgccgaaaaatcaaaaacggctgcggaatttcttcatgatctgaagctgcttcctcatgtcggcgatgtccgccagctcggtttgatgtgcggcatagagcttgtgcaggataaggggacaaaacagccttatccgcctgaaaagcggatgggatacaaggtgtccttgaaaatgagagagctgggtatgctgacacggccgctcggtgacgtcatcgcctttcttccgccgctcgccagcacaaccgaccaattacaagccatgatctccattatgaaagaagcgatagccgaggtgaccggccgtggattttgacggatggctcctcggaaggctcgatgcggtgaaaagagacgggctgtatcggacgctgcgaacacaggaaaccgctcttaaaaccaaggggcaaaagcggcagacctgggcgtccaatgactatttaggtctgtcaaaagatgaacggctgatcacagccgcgcaaacagcgctgagccggttcggagcgggaagcggcggctcacggttaacgacaggaaatactgtgtggcacgaaaaacttgagcaaaaaatctccgactttaaacagacggaagcggctttattattttcaagcggttacttggcgaatatcggcgtgcttgcctcactgcctcaaaaaggcgatgtcattttaagcgatcaactgaaccatgcgagcattgttgacggctgccgtttatcaaaagcggaaaccatcgtgtaccgccatattgatatggctgatcttgagaaaaaacttgcctccgtccagactcggaaccgccgctttatcgtcacagacggcgttttcagcatggacggcaccatcgcgcctcttgaccgaataatgccgcttgcaaagcagtaccaggcatttgtgatagcagatgacgcgcatgcaaccggtatactcggggaaaacggcggaggaaccagtgactatttcggtgtttgtcctgatgttgtcatcggcacattaagcaaagctgtaggaacggaaggcggttttgccgcgggatcaaacatttttattgattttttgctgaatcaggcgcggacgtttatttttcagacggccctcccgccgtcaatttgtgcggcttcgcatacggcatttgacctcatatcagatatgcacgatacgcgccgtgagctgcagtcgtctgtcaaaaagataaaaacgcgtctggccgatatgggctttactgtaagaggcggagatacaccgattatccccgttatcatcggtgatgcaaaaacagcggtttcagccgctgcgctgcttgagaaaaagggaatctgcgccccggccatccgcccgcccgccgttccggaaggcgaaagcagaatcaggctgaccgttacggcggatcgcagcttacaggacatagacgagctgacggaagcatttgattccattagaaaagagctgaatataaacaaatgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgaggggcaggcggcatttccgttccgcttggtgaaaattacttagtcagtgatttgataaaagccttggaattaccggcagtgattgtcgccaggcctgatctcggaaccatcaaccacacatatttaaccgttgaatatgcgaaaaacatgggaatagaggttctcggtattattatcaacggcgtaaagagccggccggggctggacgagaagacaaacccgagcatgattgaaacattatgcaaagttccgattttgggaatcacaccgaagctggatcacgtttcaccggaaaacattcaacacatgattgagaaacatatagatgtttcctctttcatgaatctgacacaaatggggagataaacatgaatcaatggatggatcttgcagagagagttctggacggggcggaagtaacgaatcaagaagcgctggccattttaaattgtcctgatgaggatcttttattgctgatgcatgccgcttttcatatcagaaaacgattttacggaaaaaaagtaaagctgaatatgattatgaatgcaaaatcaggcctgtgtccggaaaattgcgggtactgttcacaatcttcaatatcaaaagcgccgatcgagtcttatcggatggtggataagcatatattgcttaagggggcaaaacgcgcccatgacttgaatatagggacatactgcatcgtcgccagcgggcggggaccgtcaaacagagaagtagatcaagttgttgatgctgtcaaagaaattaaagaaacttacggtttaaaaatctgcgcatgcctcggtctgctgaagccggaacaggcagagcgcctgaaacaggcaggagtagaccggtacaatcataacatcaatacatcacaaaggaatcactcaaacattacgacttcccacacgtatgacgacagggtcaatacagtggaaacggcgaaacaatcggggatgtcgccttgttcgggtgtcatcgtcggcatgaaagaaacgaaacaggacgtcattgatatggcgaacagcttaaaagcgcttgacgccgacagcatcccggttaattttctgcatgcgattgacggaactccgttagaaggggtaagcgaattacatccggtgtattgcctgaaagtgctcgccttgttccgttttatcaatccgacaaaagaaatccgtatctcaggaggccgggaagtcaaccttcgttcgctgcagccgctgggactttacgccgcaaattcgattttcgtcggagattacttaacgacagcagggcagcatgaaacagaggatcatcaaatgctccatgatttagggtttgaagtcgaatccgttgaagaaatgaaagccggcctgcaatccgcctgcaatacggaggtataagatgacggcgggcctatcgactgcacatccgtccctccatgcggattcggatttttggaatgacccttacccgttttatgaaaaactgcgtgccattgatcctgtttataaaggaaccgtattaaaacatccgggctggtatgtcaccgggtataaagaagcggcagcgattttgaaagacacccggtttaaaaaccgcgtcccttttccggaagcttcaacgaaatatcaaaatctatctcatatccagcacgatatgctgttatttaaaaatcaatcagaccataagcggatgcggatgcttataggtaaagaatttaccgcaaagacggcggaatcacttcgcccctgtataaaagaaacggttcatgacttgttggatcaaatccaaaacaaaaaaaacgcagaccttgtttcagagtttgcctttccattggcaagcctcatcattgcggagatactcggagtgccgaaagaggagagatatcaattcagacaatggacggcagacgtcattcaggccattgatcttacccggtcaagaaagatgttagtcagagcaagcgacaccgcaggcaggctgactgcatatttcagagatttgattcacgagcggaaagcacatcctcaggaagacttaatcagcaggtttattatgggggaacagctttcaaaagacgaagtgctcgcgacatgtatcttacttgtcatagccggacacgagacgacggtaaacctcatgagcaacggtgtgtttactttattgaaacaccctgaacagcttagcgcactgagagaaaacccctcgcttattgaaactgctgtcgaggaatgtctgcgctacgacagccccgcgcagctgacggcacgcaccgcttcagaagactgtgaaataaatgggaagaccataaaaaaaggagagcaggtatatatccttttaggggcagccaatcgcgatccaagcatattcgatcagcctcataaaatggacatccaaagaaaaccgaatccgcatcttgcattcggaaagaacgcccatttttgcataggctcctcattagcgcgcatcgaagcacaaattgcaattctcacactgtttgagcggatgcctaagcttcggctggccgcacaccgccttgaataccgcaagctcattggttttaggtcgctcaaagagcttccggttgtccttggctgaatgaccatgcaggagggccggattttatcggttcctcttgcaggaaataaatgaaagaaaaaagaatacatatttataaagcaaaaatcctctctgatccatctcactatccctaaaaaaactcgctgctcagccattcaatatcatacagcaagaatctccttttctttcgccaaaacggaaaattcaccatgatgcacattttttcagcctcagaaacggtgcaaaatcggcatgttttctgctttattttcttgatctttgtaagcgcttactaatattgagcagaaaagagggggatttgtggacattgttattattttattggcattaggcatgctgatgtttgcggcttaccggggcttttcagtcattttattcgccccgatttgtgcgctgtttgccgtgctcctgacagatccaagcttcgtacttcctttcttctcgaatatatttatggagaagatggtaggatttattaagctgtattttcccgtatttcttttaggggccgtttttggcaaggttgttgaaatatccgggctcgccgagtcgattgcaaaaacaatcgtcaggcttgtgggagcaaaaagagccattctcgccatcgtcttaatgggtgcgattttaacgtacagcggcgtcagtctcttcgtagcggtgtttgccatttatccgtttgctaaaaacctatttattaaagctgatattcccaagcgtctgatacccggtacgattgcattgggcgcgtttacttttacaatggatgcgcttcccggcacaccgcaaattcaaaatgtcattccgacagctttttttaaaacaaacatttatgccgctccctggctcggactgattggcgcagcatttgtgcttacggccggaatgatttatttagaatcccggcgcaaaaaagcggccaatgccggagaaggctatgctggatttcaatctgaagtttccgctgcagaggattcctcaagtctggctaatgaaaaacatacgcctgttttaccgcaggaggcagaacccagccccgcgcggcaagtgctcgcctttgttccgcttatccttgtggggatcatgaacaaatgcttcacgatgtggctcccgcattggtaccctgacggatttgattttgcgcagctcggtttaaaagcgttcgggaagattgacctttcctccgtcactgcgatctggtcagtagaactcgcactgctcatcggaatcatgacaacgattttgttcgattggaaaaaagtgctcttcaatttgaaagaaggactgaatgagggcatcgggggtgccttgctggcgtcgatgaatacaggagccgaatacggatttggcggcatcattgcggcgcttcccggctttaaaatggtcagcagcggcatatcgcagacgtttactgatccgctcgtcaacggagcggtgacgaccactgcgcttgccgggattacaggatcggcatcaggaggaatgggcatcgctttaagcacgatgtcagcagcatatacagaagcaatcaatacattccacattccgccggaggtcatgcaccgggtgatttcgatggcctccggcggaatggacactcttccgcataatggcgccgtcattacgctgctcgcggtcaccgggttgacccaccgccaatcctacagggatatctttgccattaccgtcattaaaacagcagctgtgtttgtcatcatcgccatttacagtctgacgggccttgtgtagccaaaacagaaaggggaaacgaatatgggaaaaggaaaagtgatggactcttataaagatgctgctgcactgatcaaggatggagacaccctcatcgcaggaggcttcggcctgtgcggcattccggaacaattaattctcgcgatcagggacagcggcgtgaaaaacttgaccgttgtcagtaataactgcggtgttgatgattgggggttaggcctcttgcttgcaaaccggcagatcaaaaaaatggtcgcatcctatgtcggagaaaacaaaacctttgaacggcagtttttaagcggggagctggaagtcgaattggtgccccaaggaacgctcgcagaaagaattcgcgcgggaggggcgggcattccggcgttttatacacctgcgggcgtcggaacatcagtagccgagggaaaagaacataagacatttgacgggcgcacctatcttctggagaaagggattacagggaacgccgccatcataaaggcctggaaagccgatcctctgggcaacctgatgttcagaaagacggcgagaaatttcaatccgctcgctgcaatggcaggcaaagtgacgattgcagaggctgaagaaatcgtcgatgccggagagcttgatccggatcaaattcatacgccgggtatttttgtgcagcatgtgctgcttggcgggattcatgaaaaacggattgaacgccgcaccgtccggcaagcatgataaaggaggctgacagaatgagagatagcagaaaacgaatgatcaaacgggctgtaaaggaaataaaggacggaatgaatgtgaacttggggatagggatgccgacgcttgtagccaatgagataccgaatgattataacgtcctgcttcagtctgaaaacggcttgctcgggatcgggccttatccggcggaaggaacggaggaccccgatctgatcaatgcgggaaaagaaaccattaccgaggtaaagggagcctcgtattttgacagtgccgaatcctttgccatgattcgcggcggccacattgatgtagcgattctcggcgggatggaagtgtccgaacggggagatttggcgaactggatgatccccggaaaaatgatcaaaggaatgggcggcgccatggacctggtgcacggagcaaaacggattattgtcattatggagcatgttaataaatatggggaatctaaagtgagaacggaatgtacgctgcctttaaccggcaggcaggtggtcgatcggctgatcacagatttggctgtattcgattttcatgatggccgtatgacgctcaccgaactgcaggaaggtgtaacaatggaggaggtctttgagaaaacagaaggtcattttactgtcagccagtcgttaaaaaacggggtcagaccaaaatgaggaggtgccgccatggattcattgcttattgaaaaaacagccgttgtaacaggagcagccggaggaatcgggcttgaaattgcaagagaattcgcccgtgaaggagcagccgtcatcatctctgatgtaaacgaacaagcggggaaagaagcggcggcaggacttaaagatgaaggctgtgaagcagtcagcatcacatgcgatgtaacaaatgaaaagcaagtggccgacatgctgcagacggtcgagaaacaattcggacgtctcgatatccttgtgaataatgcgggcattcagcatgtcgcgcccatcgaggaatttcccaccgaacagtttgaacggctcattcgtgtcatgctgactgcgccatttatcgcaatgaagcatgcattccccattatgaaaaaacagcaattcggtcgaatcattaatatggcgtctgtcaacgggctgatcggttttcacgggaaagcggcatataacagcgccaagcacggcgtcatcggtttaacgaaagtcggtgcacttgaaggcgcggctgacggcattaccgtcaatgcgctttgtccgggatatgtggacactcagcttgtccgcaatcagttaaaggacatttccgcaacaaggaatgtaccgtacgagcgggtgcttgaggacgtcatctttccgctcgttccccaaaaacggctgctgtcagtgaaggaaatcgctgattacgctgtatttttggccagcgacaaagcaaaaggggttacaggtcaggccgtagtcatggatggcgggtataccgctcaatagttcttatatttttttaaaaacagccgctctgaacggctgtttttttatgcctgaaaaacttgttcactcaataggccgatttactgcccaaccggtatccgggctgggtcattcacatgttctgcggcgtattttgtccttgcagatttttctcatccagatccatttctgcgccgcatttataatcaagcgccatcagtttacaatccttcacagatatacaaatgaatttttacaataaacataaaatatgtaatttctgacacaataatgccaatagccctaaaacatatgaaacatgaagagcgcgacctaagtgatgaagagccggtaacaggctccactccggcttttcatcatctctctttaagactgattttcggtgaaaccccatgttttattttatgaataaatatatctaattcgtttgtaaaatcgaacaataactcctccgaaagtattctatacacatttgttataatcatgctaggatgttagataaagggataatttgtaggatattgtatttctgttcaatatgatcggaggaatctcatgaacaatcttgcctttttatttcctggacaagggtctcaatttgtaggaatgggcaaacaattttggaatgattttgtgctcgcaaagagattgtttgaagaagcgagcgatgcgatctccttggatgtaaaaaaactgtgttttaacggagatatgaatgaattgacaaagacaatgaacgcgcagcccgctattttaacggtcagtgttattgcttttcaagtgtatatgcaggaaataggggtgaagccccgcttcctggcaggtcatagcttaggcgaatattcagcgcttgtctgtgccggcgccctttcttttcaggatgccgttacacttgtaaggcagcggggaattcttatgcaaaatgcggatcctcagcagcaggggacgatggccgccgtgactcacctctctcttcaaacgttgcaggaaatatgttcgaaagtgtcgacggaagactttccggcaggagtagcctgcatgaattcagaacagcagcatgtgatttccggacaccggcaagctgtggaacgtgtcatcaagatggcggaggaaaagggagcggcatacacttatttgaatgtcagtgcgccttttcacagttcgctgatacgatcagcatctgaacaattccagactgtattacaccggtattccttccgggatgccgcatggccgatcatttcaaatgtcaccgcacgcccttacagcagcggaaattcgatcagcgaacatctcaagcagcacatgacgatgccggtaagatggacggaatcgatgcattacttgcttttacacggagtcacagaagtcatcgaaatgggtccgaacaatgttttagccggtctgctgagaaaaacaacgaatcacattgtaccttatcccttaggacagacatctgatgttcacttgctttccaattcagcggaaagaaagaaacatattgtccgtttacgcaaaaaacaactgaataaattgatgattcaatccgtcattgcgcgaaattacaacaaggattcagcggcttattccaatatgacgacggcattatttacgcaaatccaagagctgaaagagagaatggaaagacatgaaaatgagctctcagaacaagagctcaaccattcgatccatttatgcaaattaatttgtgaagctaaacagcttccggcttgggaagaattgcggattttaaaataaagcgcccaggaggggacctatgtataccagtcaattccaaaccttagtagaagtcattcgggaaagaagcaatatctctgatcgcgggatccgttttatcgaatccgataaaaacgagacggttgtctcttatcgccaattgtttgaagaggcgcaagggtatcttggctatttacagcatctcggcattaagccgaagcaggaaattgtatttcaaatccaagaaaacaaatcatttgtcgttgctttttgggcttgtatattaggaggaatgatcccggtgccggtcagtatcggagaagatgatgaccataagctgaaggtctggcgcatttggaatatattaaatcatccgtttctgattgcctctgaaaaagtattggacaaaataaagaaatacgctgcagaacacgatttacaggatttccatcatcaattaaacgaaaaatctgacatcattcaagatcaaacctacgattaccccgcttcgttttatgaacctgatgcggatgaactcgcctttatccaattttcttcaggatcgacaggagatccaaaaggagtcatgttaacgcatcacaacttaatacataacacgtgcgccattgggaatgccctagccgttcattcgaaagactctttcttatcatggatgcctttaacgcatgatatggggctcatcgcctgccaccttgttcccttcataaccggaatcaatcaaaatctaatgcctacagaattatttattcgcagacctattctttggatgaaaaaagctcatgaacataaagccagtattctatcctctcctaatttcgggtacaactacttccttaaatttctgaaaaacgaaccagactgggatttatcccacatcaaggtcatcgcaaacggtgcagaaccgatattgccggagctctgtgacgaatttttgaaaagatgcgcagcattcaatctgaaaagatccgccattttgaatgtttacggtttagcggaagcttcggtcggcgcagcattctctaaattaggtaaagaattcgttcccgtttatttgcatcgtgactatttaaatcttggtgaaagagctgtaaacgtcagcaaagaggatcaaaattgcgcttcattcgtcgaagtgggacgacctattgactattgtcagcttcggatctccgatgaagcaaatgaaagagtagaagacggaatcatcggccatatccagatcaaaggagacaatgtgactcaagggtattataacaaccccgagagtacggaaaaagcgctgacttctgacggctgggtaaaaacgggagacctcggattcattagtgaaagtggtaacttagtcgtaacgggaagagaaaaggacattattttcgtgaacggaaaaaatatctacccgcacgatattgaacgggtcgcgattgaaatggaagaggttgacttaggaagggttgccgcctgcggtgtatatgatcaaaagacacaaagcggagaaatcgtgctctttgttgtttacaaaaaatcacctgaaaaattcgcaccgcttgtcaaagagataaaaaagcatttgctcaagcggggcggctggagcataaaagatgtccttccgatccgaaaactccctaaaacaaccagcggaaaggttaaacgctacgaacttgccagacagtatgaggcagggaatttttcaacagagtctgccgccatcaatgaatatttggagagcagcccggaaacgtccggacagactcccattcatgaaattgaaacggaattactgtctatcttttccgatgtgctcaatgggaaaaaggttcacctcgctgacagttattttgatatgggagcaaattcattacagttatcgcagattgccgagcgcatagaacagaaattcggacgcgagcttgccgtttcagatctctttacgtatccttctatcactgatttagcggcatatctgtctgaaagccgggctgaaatcaagcaggacgtggcagcgaaaccaagccacgtgacgccgaaagatatcgccattatcgggatgtcgctcaatgtccctggagcatcaactaaaaatgatttttggaatctgcttgaaaaaggtgagcacagcattcgagaataccctgcatcccggctgaaagatgcggcggattatttaaagtccatccaaagcgaaatcaatgagaatcagtttgtgaagggcggctatttagatgaaatcgaccgctttgattactcgttcttcggtttagctcctaaaacggctcagtttatggaccctaaccaaagactgtttttgcagtctgcatggcatgcgattgaagatgcgggctatgccggcggcagcatgaacgggagccgtgtcggggtatatgcagggtactcgaaggtgggctacgattatgaacgtctcctttctgcgaattatccggaggagcttcatcaatatatcgtgggcaatctcccttccgtgttagccagccgaatcgcttatttcttaaatttaaaagggccggcggtgacagtcgatacggcgtgctcctcatcgcttgccgccgttcatatggcatgtaaatctttaatatccggcgattgtgaaatggctcttgccggcggtatccggacatcgctcttgccgatctgtatcggacttgatatggaatcttcggacgggtacacgaaaacgttcagcaaagattcagacggtactggcacaggtgaaggcgcggccgcagtcctgctgaaacctctgcaggatgctgttcgcgacggagaccatatttacggcgtaatcaagggaagcgcgttgaatcaagacggaacaaccgccgggattacagcaccgaatccggcagctcagactgaggtcattgagacggcctggaaagacgcgggcattgcccctgaaacactgtctttcatcgaagcgcatggcaccggaacgaagctcggcgatccggttgaatttaacgggctttgtaaagcgtttgaaaagtatacggcaaaaaaacaattttgtgcgattggttctgttaaatcgaacatcggtcatttgtttgaagcggcaggcatcgtcgggctgatcaaatctgtcctcatgctgaatcacaagaaaaatccgccgttagtgcactttaatgaacctaatccgctcattcattttcactcttcaccattttacgtaaaccaggaagctgcagcgttcccatccggtgatgagccgctgcgaggcggagtcagctcatttggctttagcggaacgaacgctcatgtggtattggaagaatatatttctcaaagtgagtatgcgcccgaggatgaacatgggccgcacctatttgttttatccgctcatactgaaaaatcactctatgaactcgcacagcagtaccggcaatatgtatcggatgacagccaagcttcattaaagtccatttgctatacagccagtacgggcaggactcatttggatcatggcattgccatgattgtatccggtaaacaagaactatcggataagctgacccgcctgattcagggagacagaaaccttcccggtgtatacatcggctacaagaatatgaaggaaatgctgcccgctcataaagaagagctgaataaacaagcagccgcactgattaagcagcgtttacgtacgcaagatgaacggatcacatggctgcatcgcgccgccgaattatttgtgcaaggagccgttatcgattggcgcgcgctttattcaggtgaaactgtacaaaagacgccattgcccgtgtatccgtttgaacggagccgatgctgggctgaagctgaccaattgcgcttaaacgaggacgaaaagagaggagaagcggcattgaatatcaatcaatcgaagtcgcacattgaatccttcctgaaaactgtaatcagcaatgcttcggggatcagagcggaggaactcgatctgaatgctcattttatcgggctcggaatggattctatcatgctgtcacaggtcaaaaaagccatcgcggacgaatttggggcagacatcccaatggatcgtttttttgatacgatgaacaaccttcaaagtgtcatagattacttggctgagaccgttccatcgtcctttgcatccgctccgcctcaagagaatgttccggcgcaggaaatacaggtcatttcagaagcacagtctgaatcggatcgcagagaaggtcaacaagagcatatgcttgaaaaaataatcgcttctcagaatcaattaattcaggataccttgcaagctcaattaaatagctttaatttgttgagaaacagcggacatcattccgatgagaaagaatacgctaaagcgcaagagaaatcaattccttctgtcaagcaggggcctccggccgtcactgcagaaaagaaagcggctcaagaagcgaaaccctatgttcctttccagcctcagaacctgcatgaacagggacactataccgcacggcaaaaacaatacttagaagatttcatcaagaaatacgcagataaaacgaaaggttccaaacaatatacggacaacacccgatttgctcatgcaaacaaccgcaacttgtccagcttccgttcgtattggaaggaaatcgtatacccgattatcgccgaacgttctgacggttctaaaatgtgggatattgacggaaatgaatatatcgatgtcaccatgggattcggggttaaccttttcgggcatcatccttcctttattacacaggttatcgatgattcagcccgttcatcattgcctccgctcggcccgatgtcagatgtcgccggtgaagttgccgaccggatccgcacatgtaccggagtggaaagggtcgctttctataattccggaacagaggccgtcatggttgccctgcgtttggcgcgggcagcaacaggaagaaagaaagtcgtggcgttctcgggatcttatcacggcacgtttgacggcgtattaggggttgccggcacaaaaggcggagccgcgtctgcgaatccgctggctccgggtatactgcaaagctttatggatgatttgattattttacattataacaatcccgattcgctggacgtgatccgcagtcttggtgatgaattggcagccgtactggtggaaccggtacaaagccgcagaccggatttgcagccgcgggcatttttgaaagaattgcgggcgatcacgcagcaatccggaacagctctgattatggatgaaattattaccggatttcggatcggtctcggcggcgcacaggaatggttcggcattcaggctgatttagtgacctacggaaaaatcatcggcggcggacagccgttaggggtagttgccggaaaagctgagttcatgaatgcgatcgacgggggtacctggcagtatggggacgattcctatccgcaagatgaggcgaaacgcacgtttgtggccggcaccttcaatactcacccgcttaccatgagaatgtcgttagccgtgcttcgccatttacaaaccgagggagaacacctgtatgaacagctgaatcaaaaaacagcctccctggttgatcggctgaatcgcttctttgaacaatcgcaagtgcctatccgcatggttcaattcggttctttattccggtttgtctcatcgcttgataacgacttgttcttttaccatctcaattataaagggatctatgtgtgggaaggacgcaactgcttcctatccacggcgcataccgcggatgatattgaacacatcattcaagctgttaaagacacggtgaaggatcttcgccgaggcggatttattccggaaggcccggattcccctgatgacggcggacataacaaatcaggggcgtacgagctttcagatgaacaaaaacaattggttatggcatcccattacgggaatgaagcgtccgccgctttaaaccagtccattatgctgaaagtggagggcgaactgcagcatacaccattaaaacaagccgtccggcatatcgttggccgtcatgaagctttacgtacagtgattcatcccgatgacgaggtacagcaagtgcagaaacggatgaatatagaaataccagtcattgattttactgttcacccgcatgaacatcggcagtcggaaattcaaaaatggctgacagaagatgccaagcggccgttccatttccatgaacaaaagcctttgtttagaatccatgtgcttacatcggctcacaatgaacatctgattgtgctcacgttccatcatatcattgtcgatggatggtcaatcgccgtatttgttcaagaactggagagcaactacgcggcaatcgtacaaggaaaaccgatttcaccgaaagaggcagatgtttcgtttcgccaatacttagactggcagcaggcacagattgacagcggccattatgaagaaggggtccgttattggcggcgtcatttctctgaaccgattcagcagccaattctgccgagcacaggttctgtccgttatccgaacgggtatgagggagaccggtgtaccgtcaggcttggacggccattgagcgaggctttaaggtcattaagcattcagatgaaaaatagcgtatttgtgacaatgctgggtgcatttcatctttttctgcaccggcttaccaaacagtcaggccttgtgatcgggatccccgcagcaggtcaatcgcatataaaacagcatgatctgattggaaattgcgtcaatatgattccggtgaagaacacgtctacttcagaaagcactttaaccggttatcttggcagtatgaaagaaagcgtgaatcttgcaatgcggcaccaagccgtcccgataacactggtggccagagagcttccgcacgatcaagtgccggatatgcgtattatctttaatttagacaggccttttcgaaagctgcatttcggaaaggcggaagcggagcccgttgcatacccggtaaaatgcaccctgtacgatttatttcttaacataacagacgcgcatcaagaatatattcttgatttcgactttaatacgaacgtcatcagtccggaaatcatgaaaaagtggggagcgggttttacaaaattgctgcaaaaaatggttgagggagattcaatccctcttgacgccatgatgctgttttccgatgaagaacagcatgatttacaagcactttatgccgaacaccagaagcgggtctcttcaataggaagcaatacagcaaatttcactgaagcctacgaggcgccgataaatgaaacggagcggcagctggcgcggatttgggaggaacttttcggccttgaacgggtcggcagatcagatcgcttcctggctctgggaggaaactcgctccaggcgacgcttatgctttccaaagttcagaagacatttcatcaaaaggtttccatcggacaatttttcaatcaccagactgttaaggaattagcacatttcattcagaacgaaacaaaagtcgtgcacctcccgatgaaggctgccgagaaaaaagcgtattacccgacatcgccggcgcagcaaagagtatatttcctgcaccaactggaaccggatcagctggcgcaaaatatgttcggccaaatatcaataacagggaagtacgatgagcaagccctgatctcatctcttcaacaagtgatgcagcggcacgaagcgtttcgcacgtatttcgacattatagatggcgatatcgttcagaaacttgaaaacgaagttgattttaacgttcatgtccggacaatgagccgggacgaatttgatgcctattcagaccggtttgtaaaaccgttccgcctggaccaagctccgttagttcgtgcggagctgatcaagattgaaaacgagcaggccgaactgctcatcgatatgcatcatatcatttcggatggttattccgtcaacatccttacaaatgaattgctggctttatatcatcagaaaccattaccggacattgaatttgaatataaagatttcgcagaatggcaaaaccaacggctgaatgaggatgccatgaagcggcaggagacatattggctggaacaatttcaagacgaaattcccatccttaacctgccgacagacggttcaaaagcggcagaacggtcttctgagggacagcgagtgacatgctccttacagccggatgtcatccgttcgcttcaagatttggcgcaaaaggcggaaaccactctctatacagtgctcctggccgcctataatgtgctgcttcataaatataccggacaagaagacattgtcgtaggcacgcctgcttcaggaagaaatcatccggatatcgaaaagatcatcggtattttcatacaaaccatcggaatccggacgaagccgcacgccaatagaacgttcacggattatctggaagaagtaaagcggcagacgcttgacgctttcgaaaaccaagactatccatttgaccggcttgtggagaaattaaatgtgcagcgggaaacaaccggaaagtctctgtttaacacgatgtttgtgtttcaaaacattgaatttcatgaaatccggcacaatgaatgtacatttaaagtgaaagaacgaaatccaggggtctctttgtatgatttgatgctcacgatcgaagatgccggtcaacagatagagatgcattttgattataaaccgggacgattcacaaaagacaccattgaacagatcaccagacactataccggcatcttaaacagtcttgttgagcagccggagatgacattgtcttccgttcctatgctgtctgaaaccgaacggcatcaactgctgacggagtgtaacggcacaaagacgccgtatccgcataacgaaacagtaacccgatggtttgaaatgcaggcggaacagagtcccgatcaggaagccgttatttttggcaatgagcggtatacgtacagacagctcaatgaacgggcgaaccgattggcgcggacgttacggacaaaaggcgtacaagcggatcaattcgttgccatcatctgcccgcatcggatcgaactgattgtcggaattttggctgttctgaaagccggcggcgcatacgtgcccattgatcctgaatatccggaagatcggatccaatatatgctgagagattcaagggcggaggttgtgttgacacagcgcagcctgctggatcaattaccgtatgatggtgacgttgtgcttttggatgaggaaaactcataccatgaggatcactcgaatcttgaatcggacagcgatgcgcatgatttggcctacatgatctatacgtcaggttccacgggaaatccaaaaggtgtcctcattgagcatcagggactggctgattatatttggtgggcgaaagaggtttatgtaagaggtgagaaaaccaacttcccattatactcttccatctctttcgatctgactgtgacctcgatatttacaccgctggttacgggaaataccatcattgtctttgacggcgaagacaaaagcgctgtgctttctgagattatgcgggactcaagaatagacatgatcaaattgaccccggcacatctgcacgtcatcaagaagatgaatatcggtggcggcaccgcaatacggaaaatgattgtcggcggagaaaatttaagcacccgtctggccaaaagtgtcagcgagcagtttaaaggccggctggacatttttaatgaatacggaccgacggaagctgtcgtcggatgtatgatttatcacttcgacgcagaacgggacaagcgggaatttgtaccgatcggcactccggctgccaatacggatatttatgtggccgatgcaagcagaaatctggttccgatcggggtaatcggcgaaatatatatcagcggaccgggtgttgccagagggtattggaaccgtccggatttaacggcagagaaatttgttgaaaacccgtatgtcccgggagcgaagatgtacaaatcaggggatttggctaagcggttgaaggacggaaatcttgtatatatcgggcgcattgatgaacaagtcaaaatcaggggacaccgaatcgagcttggtgaaattgaagcagcaatgcataacgcggaagcggtgcaaaaagccgcggttacagtgaaagaagaagaagacggcttaaaacaattatgcgcgtattacgtaagcgacaagcctatagcggctgcgcagcttagggaacaattgtcatcggagcttccggactacatgattccgtcctattttgtccaactggagcatatgccgttaacgtccaacgggaaaataaaccgtaaggcactgccagcaccagaagcgagtctgcagctgacagctgaatatgttccgccgggtaatgagacggagtccaaactgacagatttatggaaggaagtgctcggaataagccatgcggggatcaaacataatttctttgatctcggaggcaactccatccgagcggctgccttagccgccagaattcacaaagagctggatgtgaatctgtctctaaaagacatattcaagtttcctaccattgaacaattggctgacaaggcgttacacatggacaaaaaccgatatgtaccgattccggctgcaaaggaaatgccatattatccggtttcttcagctcagaggcgtatgtatttgttaagtcacacagaaggcggcgagctgacttacaatatgacgggtgccatgaatgtggaagggacgatcgatcccgaacggttaaacgccgctttccgaaaattaatcgcgcgtcatgaagcgttgcggaccagctttgatttatatgaaggcgagccggcacagcgtattcatcagaacgtcgactttacgatagaacggattcaagcaagcgaagaagtagcggaagaccgtgtgcttgatttcatcaaagcgtttgacttagccaaaccgccgctgatgcgggccggactgattgaaattgaacctgcacggcacgtgcttgtggttgatatgcatcatatcatttctgacggcgtgtccgtcaatattctgatgaaagatttaagccgaatctacgaggggaacgaaccggacccgctctctattcaatataaagactttgcagtttggcagcaatcggacattcagaaacggaacatcaagagccaggaagcgtattggctggatcagtttcacagtgatattcctgtactggatatgcctgcggattatgagagacctgccatacgcgattacgaaggcgaatcatttgaatttcttatacccgaacacttgaaacagcgtttaagccaaatggaagaagacacaggagcaacactgtatatgattttattggcggcctatacgattcttttatccaagtacagcggacaagaagatattatcgtaggaacgccatctgccgggcggactcatttggatgtagagccggtcgtgggaatgttcgtcaatacgttagtcattcgcaatcacccggcgggccgtaaaacatttgatgcctacttaaacgaagtaaaagaaaacatgctgaacgcctataaaaatcaagactatccattggaagaattaattcagcatctgcatcttccaaaagattcaagccgcaatcctttattcgatacgatgtttgtgctgcaaaatctcgatcatgctgaattgactttcgattctcttcaactcaagccgtattcatttcatcatccggttgccaaattcgatttgaccttgtcgattcaggcggaccaagacaactatcacggactgtttgaatattcgaaaaaactgtttaagaaaagcagaatcgaggttttatcaaacgactacttacacattctatcggcgattttggaacagccaagcattctaattgaacatatcggattgagcggcagcaatgaggaagaagagaacgcgcttgattctattcaattgaacttttagggaaaagcattatttctttaaattatataaaatgaggtgctccaatgtcggtatttaaaaaccaagaaacgtactgggaaaacctgtttgatgaagaagacggattaagcgcattcccttactttaaagcagcggataaagcgtcgtttgcccgtaccggctaccaggaaaaatgcatctgccgttccttatctccggaagtatctcaaagaatcatgacaatggcgaatcattccgatatggcggcctatctgattttattggcgggtattgaatgcttgttatataaatatacggatcaaacgagcctgattcttggcattccgacggtatcgaagcaaaaagccggccagtcagccgttaacaacattgtcctcttaaaaaatacgctttcaaacgagagtacatttaaaaccgtattcgggcagctgaaagaagccgttaatgattctctgaaaaatcaaaacctgccgtttagaaaaatggttcagcatctgagcgtgcaatacaatgacgagcatctgccgttgattcataccgtcgtttcgcttaacgaaattcattccttgcaatttaaagaagatactgcagccgatacgctgtttcactttgatttggagaacaacgggattcatttgaagcttttttataacggcaatctgtacgatgagcgctatatcaatcaaattgtgtcccatttggatcagctgctgtctgtgattctgtttcagcctcaagccgcgatccatacggcagagatcttaccggaagcggaaaaacagaagctattgtttgattttaacgacaccgtcagagatttctccgggagcagaacagtctatcaattatttgaagagcaagcagaaagaacgcctgagcatgcggccgtcaagtttaaaaacgaccatttgacgtacagggaactgaatgagaaggcgaaccgtttggcaagaacattgcgtaattgcggggttcaacccgatacgttagtcgccattctcgctgatcgttcattagagatgatcgtatccattatagccgtttggaaggcagggggcgcttatgtgcccctggatcctgaatatccaaaagagcggcttcaatatttgcttcatgatgcggatgcagacgttctccttgttcagcgtcatttaaaaaacagtctcacctttgacggcccggtgattgatttgaatgatgaaacatcataccatgccgatagctcattgttatcaccagcaacgggacacagccatttagcctatgtcatttatacgtcgggtacaacaggaaagccgaaaggagtcatggttgaacacggcggcattgtgaattcgctccaatggaagaaggcgttttttaagcattctccggcggatcgcgtgcttgtcttgtacccgtatgtttttgatgcgttcattttaaatttcttcggcccgctcatctcgggggcaactttgcacctattgcctaatgaagagaataaagaaactttcgccattcaaaatgccataaaacaagagagaattactcatttctcaacttctccccgtcttctgaaaacgatgatcgaacagatgaacacagaggacttcatccatgttcagcatgttgttgtaggcggtgagcagctggaaacagatacagttgagaagctgcattctctgcagcctcgcattcggatcaataatgaatacggaccgacagaaaacagcgtggtatctacatttcaccctgttcagtccgctgatgaacagatcacaatcggcagcccggtggccaaccatcaagcttatattttaggagcgcaccatcaaatccagccgatcggcgtaccgggagagctgtatgtcggaggagcgggagtggcccgcggctacctcaatcgtcctgaattgacggaggaaaaatttgtggagcatctgcatgtccctggtcaaaagatgtataaaacgggtgatctcgccagatggctgccggatggaagaatcgaatatttagggcggattgatcatcaagtgaaaattcgcggctaccggattgagatcggcgaggtagaggcagccatgttcaatctggaaaacgttcgtgaagccgcagtcgtcgcgcgggaagacgcagacggggccaaacaattgtatgcctattatgtcggcgggccttctttgaccgctgcgcagttcagaaaagaattatcccgggaactgccgaattatatgattccctcccgctttatcccattggaacgcattccgctcacttccaatgggaagattgatctgaaagctttgcctgctgctgacgaaaatacgcgggcggaatacgaatacatagccccgcggaacacaatagaagaactgctggcgtctatctggcaagaagtattaggggcagaacgtataggaattctggataatttctttgattttggcggagattcgattaagtcaattcaggtgtcatccagattgtatcaagccggatacaaggttgatatgaagcatttgtttaaacacccctcgattgctgaacttagtcagtttgtagcgccggtcagcagggtggctgatcaaggagaagtgaatggcggaaccaagctgaccccgattcagcattggttttttgaacaaaacatgccgcatgcacaccattacaatcaggccgtcatgttatattcggcggaaagctttaaagaggctccgcttcgccggacgatggaacagatcgcgtcgcatcacgatgccttgaggatgatttttgaaaaaacgccggatggatacgctccgcgaattacaggaacagatgaaagtgaactataccatctggaagtgatgaattataaaggggaaaccgatccggctcaagcgattgccgataaagcgaatgagattcaaagcagcatggtattagacaaagggccattgatgaagctcggtttgttccaatgtccggacggagatcatttgctgattgcaattcatcatttgctgattgacggagtatcctggcgtattttgctcgaagattttgcaagcggttatgagcaggcagaacgcggacaaacgatccagctcccgcaaaaaacagattcgtttccattctgggccgatcaattgtccaaatatgcggcggaaaccgacatgaaagaggagattgcttattggactgagctttcaagcataaagcctcagccattgcctaaggacactatcagcgaaggatcgttattaagtgacagcgaagaagtgacgattcaatggacaaaagaggaaacggagcaattattaaaacaagcgaaccgcgcctacaacacggatatcaacgatctgctgctgacttcgttagggctggctgttcacaagtggacaggcacggaagacattgtcgtgaatttggaaggccacgggagagaaccgattattccggatgctgacatttcccgcacgataggatggttcacaagccagtaccctgtcgtcctgaggatggaagccggaaaagacctgtcgcagcggatcaagatcgtaaaagaagggctgcgccgcatccctgataaaggaatgaattacagcatcatcaaatatatatccgggcatccggaagccgacagcatgcagctgaatccggagatatcgtttaactatttgggacaatttgaccaagacctgaagcatcaggctttgcgcatatcgccatattccacagggttatcgatgaacgaaaaccaagagagaacggccgtgcttgatttgaacggcatgattgccgaagggacattatcactgacactgagctacagcagcaaacaatacgaaagatctactatggcgcaatttgcccaagggttgaaagaaagtctgcaagaagtcattgcgcattgcgtaagccggcagcagacttctctcacaccaagtgacatcctgttaaaagatatctcaatcgacgaactggaacagcttttggagcagacgcgtgaattaggcgaagcggaaaatatttatccattaacgccgatgcagaagggcatgctgtttcacagcttatttgatccgaattcaggtgcttattttcagcaaacgatgtttgatctgcatggagatctggagattgattcattttcaaaaagcttggacggcttatcgcaaaaatatgatattttccgcacgaatttttacagaggctggaaggatcagccgctccaaattatattcaaaacgaaaaaaatcggttttcaattcaatgacatacgagagatgaaggaatcacaaaaagaagcgatgattcagcagtatgccagagaagataagatgcgggggttcgacttagaaaaaggcgcgttaatgcggctattcatccttcgtacggatgaaaagacataccgttttatctggagcttccaccatattttgatggacggctggtgcctgccgctgattacaaaagaaatattcgagaattactttgccttgcttcagcaaaagcagcctgaacaatcatcaattactccgtacagtcaatatattgaatggctcggccggcaagatgcgaaaaaggccacggcttattgggatcaatacttggagggatatgaggagcaaaccggccttcctaaggatcaccatgcagcggaagacggacgatacgttcctgaaaaagtgacgtgtgacataagctccgatctcacttcgaaaatgaagcggacggcaggccagcatcatgtcacgctgaacacgctgctgcagacggcatgggcggttttgctgcagaaatataaccgcagccgggacgttgtgtttggaagtgttgtatccggaagacctgctggaattccaaacgtggaaaccatgatcggcttattcattaacaccattcccgtccggttccggtgtgaagccggaacaacgtttgccgagcttatgaaagaggcgcaagaaagggctgtagcgtctcaacaatttgagacgcacccgctgtacgatattcaagcgcgcacaacgcaaaaacaagatttaattacacatttaatgatattcgaaaattatccggttgatcagtatatggaaagtataggccgccagaacggaacatccatcacgatctccaacgtgcaaatggaagaacagaccaactacgattttaatttgaccgttataccgggcgacgagatgaccatctcttttgaatacaatgcaaatgtgtatgatcgggcaagcatagagcgggttcgggaacatttcatgcaaatcctgcaacaagtcgtgacaaatgcggatatccgggtggatcaagcggaattgttaacggaaggcgaaagaagaacccttctgcagacgcttaacgacacggccgcgccgtttccgcagacgccggttcatcaattatttgaagagcaatcgcagcgtacgcccgatcaagcagccgtcattgataaggacaggcagctcacgtacggagagctcaataagcgggccaaccgactcgcgcgaacgttaagagcgaaaggagtccagacggatcagcctgtagccatcatcacgagaaacagcatcgaatcggtggtcggaatccttgccgttttaaaatcagggggagcctatgtccctatagatccggaatatccgcaagaccgcatacggtatatgctggatgactcccaagccggaatcgttttaatgcagcgggacgtcaggaaacagcttgcctatgaaggcgtcacggttttacttgatgatgaaagttcttatcaccaagatggctctgaccttgctcagataaatgatgtgagccatttggcatatgtcatttatacgtcaggttccacaggccggccgaaaggcgtactaatcgagcaccaaggcttgaccaattatatttggtgggcgaaagaggtttatgtaaaaggcgagaaagccaacttcccattgtattcgtcaatttcttttgatctgacggtgacttctattttcacgccgcttgtcacaggaaatgcaatcatcgtctatgacggagaagataaaacagctctgcttgaatcgattgtgcgagacccgagggtggatatcattaaattgactccggcccatttgcaggttttgaaagaaatgaacattgccgatcaaacggctgtccgaagaatgattgtgggcggggaaaacttaagcacccggttagcccgcagcattcatgaacagttcgaaggccgggttgaaatatgcaatgagtacggaccgacggaaaccgttgtcggctgcatgatttaccgttatgatgccgtaaaggacagacgggaatcggtaccgatcggaaccgctgcggcaaacacgagcatttacgttcttgatgagaatatgaaacccgcgccgatcggagtgccgggagaaatctatatcagcggcgccggtgtggcaagaggatatttgaaccgtcccgaattaacggcagagaaatttgtcgatgacccgtttgaacccggagcgaagatgtataagaccggagatttggcgaagtggctggcggacggaaacattgaatatgcgggcagaatagatgaacaagtgaaaatcagaggttatcgtatcgaattaggcgagatcgaggcggcactgcttcaagaagaagcgatcaaggaagctgtcgttacagccagagaggatgtccacgggtttaaacaattgtgtgcatattacgtaagcggcgggcaaacaacggctgcccggctccggaaacaattgtctcatacccttgcaagttatatggttccggcttattttatcgagcttgatgaaatgcctttaacttctaacggaaaaataaacaaaaaagggctgccggctccggatttcgagctgcaggacagagcagagtataaagctccccgaacaaaagcggaagaaatattagtttctgcctgggaatcggtattaggcgctgaaaacgtcagtattcttgataatttctttgaccttggcggagattccattaaatccattcaagtatcctccagattaaatcagcaaggatacaaaatggaaatcaaagacttgtttcaatatgcaacaattgcagaattgagtccgcatatcaagcagaatctgcgtatagccgatcaaggtgaggtcaaaggaaaagtcagcctgactcctattcagcattggtttttcgaacaaataacgacagatcagcattattataatcaagccgtcatgctgcatgcgccggaaggttttcaggaaacgcagcttcgtcaaaccctgcaaaaacttgctgaacatcacgatgcgctccgcatgacgttccggactacggaaaatggctgcgaggcacagaatgaagaaatcgcccaaagcggactgtaccgcttagaagtcctgaatctgaaagaagattccgatccgggacggacaattgaagccaaagctgatgagatacaaagcagtatgcgtttaagtgatgggccgttaatgaaagccgggttgtttcaatgcgcaaatggagatcatctgctcatcgccatccatcatttgattatagacgggatttcatggcgcattttactggaagatatcgttagcggctacaagcaagccgagaatgggcgagtgattcaactgccgcaaaaaacagactctttccaattatgggctaagagactttcagaatatgcgaaaagtgaaaccataaaacaggaacaggaatattggacaaagatcgaacaaaccgaagtcaaaccgctgcctaaagattttcatgaaacccatacaactgcaaaagacagtgaaacagcaactgtggaatggacgaaagaggaaacggagctgctattaaaacaagcgaatcgcgcttataacacggagataaacgatttgcttttaacttctctcggtctttccatatcgcattggtcaggactgaaacaaattccgattcatttagagggacacggccgagaacagattatacaagatatagatatctcccgcacggtcggatggtttacaagtctgtatccggttgtgctgcacgcgcagccgggcaaagagatctctgattatatcaagacgaccaaagaaggattgcgccaaattccgcataaagggatcggatatggaatagcaaggtacttaagcggcggaatgccatcgaaactcaatcctgagatcagctttaactacctgggacagtttgaccaagatttacagcagcatggggttcaattatcttcttattcttgcggttcagactctagcggaaatcaagaaagaccgtatgtattgaatataaacggaatgatcaccgacggccggctgaagcttacgatcagctacagcagcaaacagtacgcaaaagaaacgatcatgcggttatcggaaacgattcaaagccgcctgcggacaatcattacgcattgcgtccatagagaacaatcggaactgacgccaagcgatattttgttaaaaggcatgtccattgacgaattggatcagctcctcattcaactgccgcatgcaggtgaggttgaaaacgtgtatccgctcactccgatgcagaaaggaatgctcttccacagcctgctggacgaggcctcaagttcttattttgaacaagcatcgttcgatttgcagggagaattaaagattgattggtttaaagcaagccttgaacgattatttgaaacatacgccgtgctcagaacccgtttttacagcggctggaacgatactcctttacaaattgtctataaaacgcaaacaccgcaaattcattttgcagatttgcgtgatatagaggagcacctgagagaggatgcaatcgcagcctatcaaagagaagataaggcaaaaggatttgacttggctcgggatccgctgatgcgcatagcgattttccgtatggaagaccgcaaatatcatttgatttggagcttccatcatattgtgatggatggctggtgcctgtctcttatcacgaaggaagtgtttgatcattatcgcgccttacaagaaggcagggaaccagaaccgtcatcggcagctccttacagcaactatatcgagtggcttgaccgccaagatcagggagcggcaaagcggtactggagcgggtatctcgaaggatataaaggtgaaaccacgcttcttcataaaatagagcagcatgaacaaaaagaatacgcctatgccaatgtgacctgccgatttgatcacgaacagacaaaacaattacagcagatcgcaaatcagcatcaggttacattaaatacgttgatccaaacgttatggggagttttattacagaaatacagcgggtccgcagacgttgtcttcggcagtgtcgtgtcgggaagaccggcggaaattcctgatgtggaacagatgatcggcctgttcatcaataccattccggttcgcatccgctgcgatgaggacagcacttttgctgatacggtgcaaatggttcaacaaaacgctctggcttcccaatcatacgatacctatcctttatacgaaattcaggcccaaacggaacaaaagcagaacctgattgaccatatcatgatttttgaaaactatccgatcggtcagcaggtcgaagagacgggacatcatagtacggagctgaacattacgaattttcatatgctggaacactcccactatgatttgaatgtagttgtcatacctggcaaacagctggccgttcatttcggttttaatgaaaacgaatatgaaaaatcagaagtggagcggatctgcggacattttgaacagctcatgcagcaagtattacagcagccgtctgtcaaaatagaagaattggagcttctctctaggcaagaaaaagaacatttgctcagccgctttcagtctaatgacatgcattacccgcttgaacaaacgatacatgagctgtttgaggaacaggcgcatcgtactccggacaatacagcggttgtattcgagggtaaacaactcacctacggagaactgaaccggcgtgccaatcagcttgcgcgaaccttgcaggcaaaaggtgtgcggaacgataagcttgtcggtattatgactgaacgctcgcttgagatgattgtaggcatcttgggagttttaaaagcgggcggcgcatatttgccgatagatcctgattctccgtctgaacgcatcagttatattttaaatgattcaagcatcagcgtattgctttaccgcgggaagctgcaggatgacatcggcttctcaggaacatgtatcgatctcatggaggaacatttctatcaccaaaaagacagcagtcttgcactctcttatcagtccagtcaactggcctatgccatttatacttccggtacgacaggcaatcctaaaggcacgttaattgaacatcgccaggtcattcacctgattgaaggacttcgacgccaaatttactctgcctacgatgcggagctgaatgtagccatgctcgctccatattatttcgatgcttctgttcagcaaatgtatgcttccttgctgtcaggacataccttgtttattgttccgaaagagattgtgtcagacggtgctgccttatgccgttattatcggcagcattcgattgacatcaccgacggaacacctgcccacttaaagcttttgatagctgcaggtgatttgcagggagttccgcttcagcatcttttaatcggaggagaggcactttccaaaacgacggtaaataagctcatgcaattattcggcgatcatggcgcttcacctgggattaccaatgtatatgggcctacggagacttgcgtagacgcgtctctgttcaacattgaatgttcttccaatgcgtgggcacgcagccaaaactatgtccctataggcaagccgttaggcagaaaccgcatgtacattcttgattcaaaaaaacggctgcagccggcgggcgtccaaggcgagctgtatattgcaggggacggcgtcgggcggggttacttgaacctgccggaactgacggacgaaaaatttgttgccgatccgtttgtaccggaggaccgaatgtacagaaccggtgatctggcccgccttctgccggatggaaatattgaatatatcggccggattgatcatcaggtgaaaattcaaggttttcggattgaactcggtgaaatcgaatcggtgatgctgaacgttcctgatattcaagaagccgccgcagctgcccttaaagatgcagatgatgaatattacttgtgcggatactttgctgcggataagacaatacagatcagtgaacttcgcgaaagaatggcccggcatttaccgggatatatgatcccggctcaatttgtgcagctggataagatgccgctgacgccaaacgggaagttgaatcgccagttattgccggctccggtcaaaaagcgtgacggcggcatagagtacgtcccgccgcaaacttcggaagaaatccagctgacagcaatttgggaagatgtcctcgggttagagcaggtggggatcagagatcacttttttgagatcggcggacactccctgcgggcaacggcgctgattgcaaaaatacaaaagcaattgcatgtccaaattcctttgcgggacgtcttccgtctcccaaccattgaacagctcgcacagacgatcacgaagacggagctgaccggatatgctgcgattcctgcaattgaaaaaagaccttattatccggtatcctcagcacaaaaacggttgtacatcctgaatcacttggaaggcggagaactcagttacaacatgctgggactgatggctgtcgaaggcaagcttgaccgtgacaagctgcagcaagccttccgcacgctgattttgcgccatgaatctttgcgcaccggttttaaaatggctgacggagaacccgttcagtatgtcttagatcacgcaaagttcgaagcagagtggtatcaggcagaagaaaatgatgcggacctttatatccgcaaatttattcgtccatttcatctggatgagccgccgctgcttcgcgtggggctgattgaacttcaacctgaccgcggaattctgatgtttgatatgcaccatattatttctgacggaacatccatgagtgtattgattaaagaatttatccgcatttatgaaggagaaacattaccgcctttgcgcatccagtataaggactacgcagtatggcagaccggcgaagcgcggttaaaacagatccaaaatcaagaagcctattggttagagctgtacagcggcgacgttcctgtccttcatctgccgaccgattatatccggccgtcggcacgggattttgcgggagccacaatgcagtttacgcttgataagcaaaaaagcgccgggttaaagcagctggcatcccaaactgaatcgactttatatatggtgctccttgcgtcttatacattattgctttcaaaatacagcggccaggaagacataattgtcggcagtcctatagcgggaagaccgcacgccgatttggaaccgattatcggaatgtttgtgaatacattggccatgagaaattaccctgaaaaagggaagacgttctctcagtatctgtccgaggtgaaggagaatgcattaaaagcttatgagcatcaagattatccgttcgaagcgctgatcgatcaactgaatatcgcaagagacttaagccgtaatccattgtttgacaccatgtttgtgcttcaaaacacggagcaggaacagttagagataaatgacgtcactttcaaaccatatccaagcgaacatacgatggctaaatttgatttaaccttaacggctgtggaagaagagtcgggtattcagttcacaatggaatacttgacggctctgtttaaaccggaaacgatcgaacgcatgatggggcattttgtgcagctgattgattcgattattaaacagcctgatgccgagctggctcgtctgaatatgatgaccaaggaagaggaaggagacattcagcaactctttaacgatactgcagttgcggaaaaacgaattccgacaacgattcatcagctttttgagcagcaggctgagcttaacccggatcatgaagccgtcatgtttggaattcagacactgacttatcgtcagctgaatgagcgttccaatcagctggcgcgcatccttcaagataagggggcctgcactgatcaggttgttgccgttctcacggatcgctcagcacatatgatcatcggcattttagccatattaaaggccggcgcagcatttcttcctattgatccggagcttcccgaaaaacggcgggcttttatgctgaaagacagcggcgccggtgtgcttttgacttgtgcaggccacgctattccgccgcgctttgaaggagaagtgcttcagcttgatgatccgatgatatatcaaggcagagcagacaatcttaatctttcctgctcggaaaatgatttaatgtatgttatttacacgtcaggcacaacggggcagccgaaaggagttcagctggagcacaagacgatgacgaatctgctcgcttatgagcaggatcatacgcagcttcgctttgacagagtgctgcaatttgccgcgatgagctttgatgtctgctatcaagaaatgttctccgcgctttcaagcggaggaacactctttatcatcggcaatgaggcaaaacgtgacatacgtcagctcaatgattttgtcagaacgcacgggatacaaacagcattcctcccgacagcgttccttaagctccttgcctcagagaaacaatatttcgaaccgtttgccgcgtgcgtggatcacatcatcgctgcgggagaacagctcatcgtaacaagtatgctgcgtgacatgctggcacgccatcaagtcacattgcataatcattatggcccgtcggagacgcatgttgtgaccatgtataccgtcgatcctgatacagatcaggagcttcagccgatcggcaaaccgatttcaaatacggagattttcattttgaatgaagccggaacgcttcagcctgtcggaatcgtcggtgaactttgtatttcaggagcgagccttgccagaggctatcataacagggagcctttgacactcgaaacttttgttccgcacccatatgactcgaatcagcggatgtataaaacaggcgatctggcccgttaccttcctgacggaaacattgaatatgcgggaaggagagaccaccaggtcaaaatccgcggttaccggattgaactcggtgaggtggaggccgctcttctcaagcacgtacaggaagcagttgtcctatcaaaagaaaataccgatggccaaatcgatttatatgcctattttacagcggagcaatcactctcgatcagtcagctgaaagaaaaacttgctggccaaataccgggatacatgatcccttcatacttcatccagcttgagaaactgccgctaaccggcaatggaaaagtaaatcgaagagcattaccgatgcctgaagcaggtttacaaacgggaaccgactacgttgctccgcggacgaatatggaagagcagctgatatgcatctggcaagacgttttgaaggtaaaagaaataggtgtaaaagataactttttcgatttgggcggccactcgttgcgggggatgacgctcatcgccaaaattcataagcaattcagcaaaaacatttcattaagagaggtctttcaatgtccgacagttgaggaaatggcaaaggcaattgcaggagctgaaaccaacgggccggattacattccgaaagccaaagcaaaagatgtctatcctgtatcttccgtgcagaagatggtttacctgtcaacacaaatagaaggcggagaactgagctacaatatgccgggaatccttacattagaaggaaaactcgacataaatcgcttgcaaaccgctttccaaagactgatccagcgtcatgaatcactgcgtaccggttttgagctggtccgcggagaaccggtgcaggtgatcaaaccgcaagcggagttttcgatggaaagatacaaggcaacagctgacgaggttgaggaatgtttccgcaccttcgtgcggccgttcgatctcagccaggctccattactcagggccggactcatcgagttagaacaagacctgcatattttcatgtttgacatgcaccacatcatcacggacggcgcctccatgaatatttttgtcgaagaactgattcaattgtatgacggcaaagagttagctccgctccgtattcagtacaaagactttacggaatggaaacatcaaaaagagcaaagagaacgaatcaagaagcaggaagggtattggcttggtgtatttcatgaagagctgccttcatttgagctgccgaaagattttgcgagaccgccggttagaagctttgatgggaaaaggcacaattttacgctcgataagactgtcacccaagggataaagcagctggaagaattgaccgggacgacagcttacatgattttgttctcggcctattccatactgctggctaaatacagcggtcagggtgatatcgtcgtcggcacacctattgcggggagaccgcatgcggatttggaacccattatcggaatgtttgtcaatacattagccatccgcaccgctccgatggcggaaaagacatttttggattatataacggaaacgaaagaaaccatgctgaaggcttttgaacatcaagagtatccttttgaagaattagttgaaaaactgggtgtaaaacgggacttaagccgcaatccattgtttgatacgatgtttgtcctgcaaaatacggaacaaacggatattgaagtggactctctcgcagtcaggccttatgaacaaacagagacggcagccaagtttgatttacagctgaacttcttaatagatcaagatgagattcagggcagttttgattactgtacaaaactgtttaaaaagaaaaccattgctgtattggccaaggattacgtcatgatcctttcggcgattatgagaaacccatccattcctttaaaagacattcaattaagcgaaaaagtaaacaaaagtaaacatctcgcaagcacaatcgaattggatttctaatcacgggggcagcggctgtcccggcatgaatgccgcggctgccgccagctgcctgaaaacaggaatgaaaccaactggagggatatgaatgtcagaattcaaacaacaggagttgttctggggccgaatgtttcacacggaagaccgtcccggtgcattcccttcgtttcaagtgtccgactcaacagtaaagcgtgatataacaagcggatctgactgtattcacagttcattgagtgcggaggtatcacggcgcatcctgaccatgacgaaccaaacgccaatggccgtctatctggttctcctggtcggaattgaatcccttttatacaaatacacgggggatgagggagtgattacaggggttccagcctttgaagacgaaactgatgaagatcttcgttcagaccagctcatgttaatcaaacagcagatcaattccggcagtacgtttaaatcaattttccatgaattgaaacatacgctggacgaagcgatcttatatcaggacgttccctttgataaaatggccggacagctgaggctgaactacaatgcaaatcatttgccgatcatccatacagttgtttcactagagcaaattcattctgatggtttcatagaaacggctgctgcagatgctttatttcagtttgctatgggtgaagacttgattgacctaaaattatgttttaatgaacaagtctatgaccgtcagtatatgatgcaggtgctcggacatttaaaccggctattttctgtcatattatttcagcctgacctcccctcggccaagtggatattttgccagaatcggagacacatacacttctcgttgacattcaaactgcgaaaactgaatatccgcgggataagacggtttatcagttattcgaagaacagatgaaacgaacaccggatcaagcagccgttatttacggagaaaagcaattcacatatcgtcagctcaatgaacgtgccaatcaattagcccgaacgttaaggaaaaagggggtaaagacggaccggctcactgcgattatttgcgagcatgagatcgaactggtcgtgggaatattggccgttttaaaagcgggaggggcctatgtgccaattgatccggattatccgaagcatcgcatacagtatatagcagaagactcccaagctgatatcatcctgacgcagagccatcttcaaaaacagttggaacttgcgggcacaatggttttcctcgatcaggaaagctcttaccacgaagacggctctgacctggaaccgatcagcagtacgaaggatttggcttatgtcatttatacgtcaggctccacaggcaagcctaaaggagtggcaattgagcatcagggcttaaccaattatatttggtgggcccgccgggtctatgtcaaaggggaaaaaaccaactttcccctatattcgtccatcgcttttgatctgacgataacgtctgttttcactccgctaattacaggaaattccattattgtctacggaggagaaaacagtgctgccttgcttgattgcattattcaggattcaaggacggatattatcaagctgaccccggcgcacttgcagttattgaaagagatgaatatccctgctgagtgcaccattcggaaattcattgtcggcggtgacaatttaagcacgcggctcgcccgtagcatcagcggaaaattcggcggaaaaatcgaaatttttaacgaatacgggcctacagagacagtcgtcggctgtatgatttattcctttgatccgcaaaacgacagacgggaatcagtgccgatcggaaccgccgcggacaacatgaacattttcgtgctggataagagcatgaagccggtgccggccggcgttccgggagaaatctatatcagcggggacggcatcgccagaggatacttgaacagagcggaattaacagcagaaagatttttgcagcacccctttgtgccagaggtgaaaatgtaccggacgggagatttagcaaggcggctcccggatggaaatattgaatatttaggccggatcgaccaccaggtgaaaatccgcggttaccgcattgaaatcggggaagtcgaatccgcatttttccaaataccgccgattcaagaagctctcgttacggcacaagaaaccaacggggaaacatccttgtgcgcctattataccgcacagcattctttaaccgcaggcgaaattcgggagcgcctgtcccggcaacttccgtcctatatgatccctgcttattttgtacagctggcagcgatgccgcttacttccaacggaaaaatagatcgtcaggctctgcctgctccaacgggaaatctcactggaaatccttatacagctccgcggacagaactggaaaaaatactggccggggtgtgggaatcggtattaggcgcagaacaggtcggaatcgatgatcatttctttgagctgggaggagattcgattaagtcgattcaggtgacctcaagcttatatcaagccgggtataagcttgacatcaaacacttgttcaaacacccgacgatctccgggcttgctccttttattgagcccattacccgaatcgcagaacaaggggagatcaaaggccgtaccttattgacgccgattcagcattggtttttcgcccggcaataccctgatccgcatcattataatcaatctgtcatgctttattttaaagggggtttggacgaatcgaagcttcagaaagtcatgaagaagattgccgagcatcacgatgctttgcgcatggtctatgttcagggagatcatgaatacgaagccagaacccgcgggatcagtgaaggagaattattcagcctcgacgtgttctctttactcgaagaaaacaaccctgccgaaacgatagaaacgatagcaaatgacattcagcaatccatccatttagccgatggaccgctcatgaaactgggattgtttcaatgtcaggatggcgatcatttgctgattgcgattcatcatctggttgtagatggcgtatcgtggaggattttacttgaggatataacgtcagcttatgagcagctccaaaacggagaagcgctcacgctccctaagaagacggattcctatctgttatgggctgaacgattgaaacgttatgcagaaagtccggaatttgaagcagaaaatcaatattggcttgagcagaaacatatctcgcaacacaaattgccaaaggataatgagcaggagaccggtctggccgaagaccgggaaacgatcatcgtccaatggacagaggaagaaaccgagcatttattaaaaaaatcgaacagggcctatacgactgacattaatgatttattgctgaccggactcggaatggctgttcatcgctggacggggcatgaagaaattcatgttcatctggaaggacacggcagggaatctatttttcaagacgttgatatttcacgtacagtgggctggttcacaacccaatacccggtttctcttcaaatccaggcagaccgggacatctcccagcggattaggacggtgaaagaacagctgcgtcagattccccaaaaaggaataggatatggcctgatgaaatattcgtccgatcatccgaaggcatcagaatggaccggacatccggaaatcagcttcaattacctcggacaatttgatcaagatctcgaaaatggaggaatcgaagtatctccttactccggagggaaaattgcaagcgacagacatcccattgcctatacgcttgacattaacggcatgatctcagacggccggctgtcattggccatcagttacagcggtaaacaatatcgaagagaaacgatggaaacatgtgcagctctcttaaagaacagcctaaaagaagtcatcgaacattgcgcagctcaagaagacattcacctgacgccaagcgatatctcactgaaggacataacaatcgaggaattagatcaatttgttcagcaaacacaacatatcggcgagattgaaaatatatatccattaactcccatgcagaaaggtatgctgttccatagtttaatcgattcggcttccagagcttactttgaacaagccgtttttgatctcaaaggcggcttggatatcgaggcatttacaatgagtttgtcgcagctggcggaaagacatgagattctccggactcatttttatacggaatggaaagatcagcctttgcagatcgtattccgaaaaaaaccgatcgaaataactgttgaagatattcgaagcatgaagaataaacaacgaaacgagttcattgccggctttgtacaaaaagataaggcaagaggattcgaccttatccaagatgcattaatgcgcgtatcaatccttcgtacagaggatgaccaagtccgattgatatggagcttccatcatattttaatggatggctggtgtctgcctcttattacgaatgaagtatttgaaacctattatgcgattcttgatagaagaaaagcggagcgggaagtcgtcaccccgtacagccgatatatcgaatggctggaagaccaggatcataagcacgcttcagcctattggcaaaaatatttggacggttatgaaggacaaactgttttactgaaagaacctgtctcaaaccaagccaagggatatcaaaaacaaaggcttgcatgccggctcggaaaacagctgtcagaagaaatcagacagactgcaagcaagcatcacgtcaccgtgaatacgttcattcaaagtgcgtggggactattgctgcaaaggtacaacaacagtcaggatgtcgttttcgggtcggttgtatccggccgcccggcagaaattccgggtatcgagtccatggtcggcttatttatcaacaccattcccgtccgtattaccgctcagcctggaatgactgtggaacaagtgttgaaaatgagccaggagcaggcattggcttctcaagggtatgatacatttccgttatatgaaattcaggctcaaactgaacaaaagcagcagctgatcagtcatatcatggtatttgaaaattatccggtcgagaaacaaatggagcatatgaaaccgaatcgtgacgcactggacattatcaatttccatatggaagagcatacccattacgatttcaatttcattgtcatgcccgcgggagaaatcgacattcattttgtatacaatagcaacgtctatgatcatgcaagtgtcaagcggatggaagagcattttatgcaaatcattaagcagatggtgaacagtcaggcgattcgcgtccaagacttggatatacttacgggggatgaacgttcgctccttatagaggcatttaatgatacggaagcagattatccaaaggaaaagacgcttcataaattgtttgaggaacaagcacagcgtacgcctgatcaaacggctgtcgtatacggggaaagccagctgacataccgggaactgaatgaaagagccaatcaacttgcccggacattgcaatcagaaggcgtgcagccggatcagccggtcgggattatggccgaacgttccttggaaatgatcgtaggactcttcggaatcttaaaagccggcggcgcgtatgtgccgatcgatccgagctatccggaagaacggattcactatatattggaggattcggatacgaagctgttgttagtacagagtcacttgaggaaaagcgtgccttttacgggaaaagtgcttgacctggaagatccgcgattctcttgggaagatggttcaaacttgaaacagactgccggaccgaatcacttagcttatgttatctatacttcgggatcaacaggccgaccgaaaggggttatggtggaacaccgatccgtaatcaaccgtctcgtttggatgcagaaacattacccgctggataagcaggatgtcattctgcaaaaaaccccaatcacctttgatgtatcggtgtgggaattgttctggtggtcgatgactggttctaaagcggtattgcttccaaacggaggagaaaagaaccctgacgtcatcttagatacgattgcgcagaaaaatgtcaccattatgcattttgtgcctgcgatgctgcatgcttttcttgagtccatggagcaaaaatccgacgaggaattaaagagaaagctggcatcattaaaatatgtatttgcaagcggcgaggctttgacgcctgcgcacgttgcggggtttcatcgcttgatcacaccggcgggtgaggctcaaatcatcaatttatacgggccgaccgaagcgacgatcgatgtatcgtattttgaatgcgaagcgggagaaacgcttaactcagttccgataggtaaaccgatttccaacattcaattgtatatcgtacaccccgaatcggaatattttcaaccgctcggtgtggcaggagagctgtgtatcgccggagacgggctcgcacggggctatttgaaccgcccggagctgacggctgagaagtttgcagctcacccatatgaagcagggaagctgatgtaccgtacaggcgacttggcaagatggctgcctgacggcaatatcgagtatttgggaagaattgatcatcaagtgaaaatccgaggctaccggatagaactcggcgagatcgaagcatctttactacaactcgatgctgtcaaagaagcggtcgtcatcgcgattgaaaaagagggctcaaaacagctgtgcgcttacttgtcaggagacgagtcattaaatacggcgcagctgaagcgtcatttgctgaacaatctgcctacgtatatgattccggcttattttgtacaagtagagaatatgccgataaccgctaatggaaaaatcgatcgaaaagcgttgccggctcctgagggaaataggcttaccggaaccgaatacgcagcgccaggaacgttaattgaaaagcagctggccgatatatggaaggatattttagctctgcctgaccccgggattaaagatcacttctttgacgttggcggccattcacttaaagtattgcagctcattcatcaaattaacgccagtatgggaatcaacatgcattatcaagccgtatacgattttcctaccatcgaaacaatggcacgcgccattcaagcggccgttttcgaatccgagacggataacgtattcgtcaagctgaatcaggaagattcaatccctgtgttctgtttcccgcctttaatcgggtatggactcgtttataatgaaatggcgaaaagacttgacggcgtcagcaccatctatgccgctgatttcttagaagagccgtctcatgggaaagagatcgttgaccggtatgcagaaagcatgataagcattcaagaacaagggccttttgttctgcttggttactcttccggatcgaatttggcttttgaggttgccaaagccttagaaaagcgggggcgcaccgtatctgatgtgattatgctggattctaaaatcaccgattcggtaactcatttatcggaagaggaaatccaagagatcgtccatctgaatatggacattattccggactactacagagaaatattaaccattccttcgattaaggataaaatcagaggctatcttgcgtatcacaatgaactgatcaattccggcgccgttaacgccaacatccatcatttgctatgcggcgatgtaaccgatgataggggctggacacaatcaacagcacagcattatcttgagtacaaattaaaaggagatcacgtgacgatctttgaacctcacaatatcgaagaaaatacggatgcaattcgatctattattaaacggattgaagaacggcatcatcacggacttgttcttgaagaacaactgtcaataggatcgtttgctggcgacacgaagtttgacaaaatgtaagtgatcaagtgtaaaacgccgctggcctggcactcagcggcgttttttattaaaaaggcgagagtcatactcctgtgttcgcaaggcttactccagagccgttctccatgactggttgtcatcaaatggtaaaaaaatcatcatacattttaaggaaaaagaaggatgtcaagttattagaaaaaagtgtagcgtatgtttatgggtactagctctattattgagttgcttaactgcggagtctgctttttactgccggtactgcaatttggtctcaaatggtaaaagttccccgaatttaaagaaaaaggaggagtgttaagttatgtgtaaaaaatgttgcgtatgcctatgggtccttgctttattattgagttgcttcactgggaagtctgcgtatgctgccagcactccaattgcaaaacatgttgggaattcaaatccgcttatcgaccatcatctgggcgcggatccgtttgcgctgacctataacggaagagtctatatctatatgtcaagcgatgactatgaatataatagcgacggcacgattaaggataattcatttgccaatttgaataaaatatccgtcatatcttcagcggatatggtgaactggacagatcacggagcgattcccgcagcgggtgccaatggggtgaatggcggccgggggattgccaaatgggcaggagcatcatgggccccgtcagccgcggtgaaaaagatcaacggtaaggataaatttttcctttatttcgcaaacggcggcggaggtatcggggttctcaccgcagacagcccgaccggtccgtggacagatccgatcggaaaaccgctggtgacgccaagtacaccaggaatgtccggtgttgtatggctttttgatccggcagtattcgtagatgatgacggtaccggttacctatatgccggcggaggcgttccgggcggttcaaatccaacgcagggacaatgggccaatcctaaaacagcaagagtcatgaaattagggcctgatatgaccagtgttgccggaagtgcatctacgattgatgcgccttttatgtttgaagattcgggaatgcataagtataacggaaaatattactattcctattgtatcaatttcgggggcgcgcacccggccgataaacctccaggtgagatcggctatatgaccagctcaagtcctatgaattctttttcgtatagagggcactttctgaaaaatccgggagcatttttcggaggcggcggaaacaatcaccatgctgtttttaattttaaaaacgagtggtatgtggtgtatcatactcaaactgtcagctccgctctttacggggccggcaaaggataccgttctccccatataaataagcttgtgcataatccagatggctccctgcaagaggtagcggcaaattttgcaggtgtcaaacagctatccaacttgaatccatataaccgggtagaagcggaaacgtttgcctggaacggacggattttgacagaggcatcctcagcacccggcgggccggtcaataatcaacatgtcacaaacattcataacggagactggattgctgtaggaaatgcagatttcgggtcaggcggtgccaggacgtttaaagcaaatgtagcgtccgctctcggcggaaaaatagaagtgcgactagacagtgcaaacggtaagcttgtcggaaccttgaatgtcccttccacaggcggaacgcaatcctggagagaaatagaaactgcggtaagcggcgcatccggtgttcacaacgtattctttgtatttaccggaactggtacaggaaacttgtttaatgttgattactggcagtttacacaaagataagcaaaggtacgttttctaagtctataaaagataaatgaaggagaggaaaaaatgatgtcgagcgtaaaaaaaccaatttgtgtattattggtatgtttcacaatgctgtccgtcatgctgttaggaccgggagttactgaagtttcagcagcaagtgatgcaacagttaatatatctgcagaaagacaagtgattcgcggttttggaggaatgaatcacccggcttggattggagacttgactgcggctcaacgggagaccgcttttggcaatggacagaatcagttaggtttttcggtcttaagaattcatgtagatgagaatagaaataattggtacaaggaagtggagactgcaaagagtgcgatcaaacacggagcaatcgtttttgcttccccttggaatccgccaaacgatatggttgagactttcaatcataatggtgacacatcagctaagcggctgagatacgataagtacgccgcatacgcacagcatcttaacgatttcgttaatttcatgaagagtaatggtgtgaatctgtatgcgatttctatgcagaacgagcctgattacgctcacgaatggacatggtggacgcctcaagaaatcctgcgtttcatgagagagaatgccggttccattaatgcccgtgtgattgcgccggaatcatttcaatacctgaaaaatatatcggaccccattttgaacgatccgcaggcgcttaggaatatggatatcctcggaacccacctgtacggcactcaggtcagtcagtttccttatcctcttttcaaacaaaaaggagcggggaaggacctttggatgacggaagtatactatccgaacagtgataacaactcggcggatcgatggcctgaggctttaggtgtttcagagcatattcatcattcaatggtagagggagattttcaagcttatgtgtggtggtacatccgcagatcatacggcccgatgaaagaagatgggacgatcagcaaacgcggatacaatatggctcatttctcaaaatttgtgcgccctggctatgtaaggattgatgcaacgaaaaatcctgaaccgaatgtttacgtgtcagcctataaaggagacaataaagtcgtgattgttgccattaataaaaataacacaggggtcaaccaaaacttcgtgttgcagaatgggtctgcttcgcaagtatccagatggatcacgagcagcagcagcaatcttcaacctggaacggatctcaaagtaacggataatcatttttgggcccatctgccggctcaaagcgtgacaacatttgttgtaaagcgttaaaggcatcagcattgcattaagccaattttcttactcggaaaagaaaattggcttattttctgtgggagagaatgttgattttttaacgatacacggacattgggtataataatgacaatgacttcaaggagtgatcaatatatgtcacggcttcacagcaaagtattaatcatagacgatgaaaaagaaattttggaactgatcaaaaccgtattaataagagaaggcattgatcgcgtagtgaccgcttcaactgcccgtgacggattggctcaatttcatcaagaaaatcccgatcttgtgatattggatatcatgctgccagacggtgaaggctatgatatctgcaagcaaataagggacatttcacacattcctattatctttttgtctgcaaagggggaggaaacggataaaattgtaggacttgccatcggcggggacgactacattacaaaacctttcagccctaaagaagtcgcataccgggtcaaagcgcagctgagacgggtctcttacttacagccttctcaaaccggaaccgtgataaaaaaagggccatttgaattaaaccaacaacaagccgagctcaccaaaaatgaagcggctattgagctaacacctaaagaacttatgcttatggcctattttctgcagcatcccaatcgggtgatcagtaaagaaacactctatcaagctgtatggggagaagactttttcggttctgacaacacggtgatggttcatatacgcaggctccgtgagaaaatagaaactgtcccatcaaaaccagactttctcgtcactgtgaaagggttaggctacaaatttgttgtaaaggatgcgtaaggatgaattggcgattaacaggcagatacatggtatctgtcatcatagtgaccatcattacagtcttcattaatttatttatttttatgttttggctcgttttacaggcgaacagccaacatgacgaagaaagtacacctgaaactttcacaagatcattcggacaatatgtcacgttatcgaacaagggtatcacagtaaacaaagagggccaaaaagctttaaaagagcagaatgcatggattcaaatattagatgaaaacggacaggatgtttatcatgatagagaacctaaaggactgaagaaaaaatatacgcctattgaaattgtaaatttacataaatataaggatgaacaattattatcaaccatttacgccggcggaaaaaaagtaaacggcaaggagtacagttactttatagggtttaaaaatccctctctcggaaaatttgtcctctcatatgataccaaggaatttgtgacgaagttcaatacaggaaccatcatattattatcaatagatgcattgatcgcgttactcattggctatctattcagccggcagctcacaaaaccgctcggccgtgtcattcaaggaatccagcggttagctaatggagattatacgatcaaaatgaaatccaaaggcatttataaagatgtgttctataatgtcaatcacttatcggaacaactatctttaagcaaaaaagaaaaagataaattagagcaaatgcgtgaagagtggatcagtcatatttctcatgacattaaaacaccattagcatctattcaaggctatgcagaaatcatcaaagatccgaattatcatctcacagtcgaacagatcagagattacgcccggatcattgagagtaaatcgctctatatgaaagatgtgatggaagatttaaatttaacgacaaggctgaaaaacaacgatgtgatgttaaataaagaacgggtaaaccttgtatcgctgctgcgggaaacgttaattgatattttaaacgattcgagatatgcggataagtccattgagcttcaaacgaacctggaaaaactgatgctgaaccttgatgcgatattgattcggagagcggtcacgaatctcattttaaatgccctcgttcacaatgatcccgatgtgaagatcgttgtacagcttgaacaaaaagaacgaactcatgtgacaattaaggacaacggcaaagggatagaagaagaggagctggaaaaagtgtttgatcgctattacagggggacaaatacaggaacgacgcatgcaggctctggtcttggaatggccatagcaaaggatattatccaaaagcacggaggggacatcaccattcacagcaccgcgggagaagggacaacgatagatatacaattatcataatggctatacaaaaaaaacggttctgctgattaataacagaaccgttttttcctattgttccgaaaacactttgattcctttgacaatgttccaaatgaaaaaatagatcgccacaaggaatgtaacagcataagtcgcaagcaggaaaggcccggcatgtctgatatcattcataccaagtaaacctgaagcgatgatgccaattccaaaaatcaaataaggaatcagatgcgtccacaaagattttttcgcatgttctttcacatcgtcccggcttaagaaatagacgataatcggaaacagaaacggcgcaaaaaatatactgaagtaacataatgaagacaaaattttattttctctcaaaccttttcacctctatgatttattgaagggggaattcttctggctgaatcccacactgaagtacaatcttattgtacaactccaaccttaacccgtattaatccgaaccttacatcaaccttaaattaacaaggacgggcaagggctcgtcttcttacagcaatcataagattcaatgccatattgagactcatcacattacatttagagcgtctacgtcggaaatacatttaatttttcgattcgattgaaaaataacgtgtaaagtcccgattcagtccagttttctttgttctatatgtgtcaggtgtgtcttattcaatagagttagagcaaattgacaggcttttaaacctcccaaaaacaagaaattaggttgatagacaatcatgagaaagatttttacaatgagttcgagctcataagaagtgaagagccaaaataatgcgaaggaggaaaagatcagatatgaaacggtcaatttctatttttattacgtgtttattgattacagtattgacaatgggcggcttgcaggcttcccaggcatctgcagcagggacaaaaacgccagcagccaagaatgggcagcttagcataaaaggaacacagctcgtaaaccgggacggcaaagcggtacaattgaaagggatcagttcacatggattgcaatggtatggcgattttgtcaataaagacagcttaaaatggctgagagacgattggggcataaccgttttccgcgcggcgatgtatacggcagatggcggttatattgataatccgtccgtgaaaaataaagtaaaagaagcggttgaagcggcaaaagaacttgggatatatgtcatcattgactggcatatcttaaatgacggcaacccaaaccaacataaagagaaggcaaaagaattttttaaggaaatgtcaagtctttacggaaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaagatgtgaatgatgcagccgatgatcagctaaaagatgcaaacgtcatgtacgcgcttcatttttatgccggcacacacggccaatctttacgggataaagcaaactatgcactcagtaaaggagcgcctattttcgtgacggaatggggaacaagcgacgcgtctggaaatggcggtgtattccttgaccagtcgcgggaatggctgaattatctcgacagcaagaacatcagctgggtgaactggaatctttctgataagcaggaatcatcctcagcgttaaagccgggagcatctaaaacaggcggctggccgcttacagatttaactgcttcaggaacattcgtaagagaaaacattctcggcaacaaagattcaacgaaagaacgccctgaaacgccagcacaagataaccccgcacaggaaaacggcatttctgtacaatacaaagcaggggatggggtgtgaacagcaaccaaatccgcccgcagcttcacataaaaaataacggcaatgcgacggttgatttaaaagatgtcactgcccgttactggtataacgcgaaaaacaagggccaaaactttgactgtgactacgcgcagattggatgcggcaatctgacccacaaatttgtgacgctgcataaacctaagcaaggtgcagatacctatctggaactgggttttaaaacaggaacgctgtcaccgggagcaagcacagggaatattcagcttcgtcttcacaatgatgactggagtaattatgcacaaagcgacgattattcctttttccaatcaaatacatttaaaacaacgaaaaaaatcacattatatcatcaaggaaaactgatttggggaacagaacccaattagttaagctttaggcggacatcagcaacgatgtccgcttttatcatcttaaacagcaatacatggaggtttacgtgaagaagtagatatgactgtacatataatgtaatcgtttcacagttttgaaaagcgtttatagcgcaatgtatgtattttacacccgccacttttattacttaagggggaacaagagaatgaaaaggtatgacgcatttccagagccaaccggcggctatactgtcggccgcacacaactggattttgagtacacggcatcagatcatacaaaaagagaactgacggtgtttgtgtactatccgtccgacagcagcgaagggaagactacatcaacgtacatgtttcctgaagtctgcgaaatgcttgatgagcagccgcttctcactgcgcggaagaatgcttactctatagatatcaagacccaatgttacgacggccttgctctctccgggaaggaaaaacgctatccggtgttattctatgtttgcggcgggggcggttctccagaatggggcacagtgatctgtacagacttggcaagcgtgggatatgtggtggtaagcatcggccatcagaatagcacgatgtataagcgtaaagatgggcgcccgtttaatgtatcaaaggattttacgtagaggttttttaatattaccttacaaaaaggggatgctgttagaatatggacccacttatatattctcttcacaatttctagtttacataatatatattctaggaagttatacagagaaatgaattacaagtctcataaaccaagtatactttagttattgagacaaagaagagaaatttataactgcaataaatgtttacagcgctagttttgattcagctgaaaaacctaacgcaaaagcaagcttgaaatgaatttcttgtttggtcattacccgcaatgagatcatttctttaggcaagcatataaaaaatcaggtctgataatactttgccgcatcttccctgcttttttccgcgtaatcataaacaaaaagaacaagattttcagcagggccatctgcccggctgccttcatcataccgctcaatgtaggaatctttgcagccgttttcatttcacgaatcgtgagagacaggcaaagaccgcaagaccgaggccgctcccggtccaaaacgacaaaaaactttctccataagataaacgtgacaatgagaaaaagcaccttgtctttcgtaacgcatcacatcctctaatatgaattgacttccgggtgcattatcttcttcctatctattcatataatgagaaaaagccgcctgataaacagacggctctgcagcttattatttgcttcggttacctgcggaagcatgagtgatccgataatgcacagttaaaaatttcagtccgaacagccacatatgatgaacggccttcaggcttgtttcgctctgggctgaaataagaaatgtctctgccagcggaagatgacacgtcccccatttcgtctggagataaatcccttcatcacccgctccgctttttcgccgtctgcttgtcaaaacaagattctgcttacgcgcataaggctttaaaatgcccgtcatttggccgtacggcagaggaagagagatattcatgtatccttccccttttgacctgtatgctgaatacagcgcagtaaaaacggtttcctgcttttcatttgttctgatccatgcacggacattttttctgccgtctttatcagagtcaactcctataatatcactgtgcatgatataccaatccggattcatggacagatgaatctgtcccgctcttctgctgaacggctcgtacacgcgcgcgaacggacgaaaccaaccgctccacgtcactttcgccatgatgtcataatcaattgtcttttcataaaaggaaataacggccggcgccagcttttcagttgaaaagtcttcagaatgcagttctctcagctgatcctgaaggccggtataatggatgtcatttgctgcatgaatgtcagtcaaaaaatctttgcctatcgttcccttcccgtaaattctgctgaacgttctttcactgttctcatcgaacggtctaggattttctattctccaccccgccaaagccggcaggataacgccaaatgcattgacggccccgtgaatccaaatcatctggctgatcgtgagcgttgcctcctcgcggtagacaccgtacgaatatatcaaagaaaaagcaattgtgatcattaacacagccgaagaactcctgatcaagatcctgcctgttttcgtaacaaacggcgccttaaagacgagatatgcatttacatacagacccgcaagatacagagcgacagcaatcacatcaagtgtctttgaaaatgtaatccccaaggcaattaggaccggcgaaatcaaaataatgactgtgctccaccggtaaagtccgcgtttctcccgtatgatcctgccgagcaatccgttaaagatcggaatgagaaaagcggaatagtgaaagtgcaccgccgtcagcagaacgataagcgggccgaaattcaggacgggaatctcaaggacatatgcgaagaaccagaatccgcccccggccaaataaatgaaacccgccataactgacatctcttctgttctgtgaatatttgttttcatcagccggcggacagcatacagtgccagtccaagcgtataaatgaaccacacaaaggcaaaaaagctgaagcctgtgacaagcgcaagcgccgcacatatagcggcaacaggataactccgtaaccacacattctctaaggtctttgacggccgaaaagcaaagcagaatacagcgggaacgaaaaaaagcacggaaaataaaacaaacgtctcagcagctgatatatgcggagcttcagccgccgcaaatcccaaaaagcaaaccacgcttaccatgagatgacgcttcagcatgtttctccctctgtttcccggaaagtcccccggtaagagaaaagcgtgccgagtatccggtttttcacatgaacctttatgctgaagcaattcatttcctcatcataagcctcataaacggttgaattcccgcacagccatgccggaatcgggattttctttccgcctatcaggagccactgccttccggatgtaataacaagccctccgtctgaagacgcttctaaatgcagttcagacagtaggatgtgaggtttgccgaagtaatcaagaattctgttttcccgctcatcatattccatgaccgcatcaaaaaaacgcgttttgcctttaaagaaaaaggtacgattccattccacgccattttgcctgtttttgttttcgatagtaaaagggatatcgtttcccctctctgagaaaaaacatctgaaaaaaacaccggtctttaaaagcattctgacaagaaaagaacctccctttatttctgacataacgccttctccgcaaaacgtgcgtgatccgtcaaatctgtaccgtttctgcagcatcgggtgcagtgattgataatgagtaatcgttttttcatacattgaatccgtcatttcacttctctctttcgttttgtatgccaggcgctcggcagcttgagcttaagaatcatgccggctatcgtaaggactcctaatgaaatcaagaatccgccgccggaatataacagtgccgttacacaaaagaagactgactgcccggcgtgaatcagccactttctccgcatgggaagcagccataatacccctaaccctgtctccagcgttcccctcacgatctctgcatcggcacagccatcatgaaagccttgaaaaaaccaatacagactgaatacgaggcacatacagacatagacaaatccgaaacggaccgatatcttcggatgtctgttttgttctatccaaagccgcaacgcatcaaagctccatgcggtagcccagcttagcagaggacgaaataaaaaccggtctatccaacttcccggcagaccgcgggccgtttcatattgatattgagtcaaaaatgaggtttgtccgttatcccgctctgtatacttccagtagcccctgccttcttttataagtgacagcggatgatcagaggcaaaagcgagcgaagacactctttctgacaagcgaggccttatgtcacctattgattcgcccgtgccggataccttcagcccaaaaccgattcgtgtttcatatagaaatctctgcggttcatctggcagcctatgaagatatgtaatgtcagaaaaacgcagatcccattctttatgaagatgcgggttttgcgtatattcccaaagcgtttctatatcagatgcaatattgatttcgacatatatcggcttctgtttcatgctccctcctcttcccttcttttgtaaacaattcctatattatcataggaacagatcaagcgggagaacgaaaaggccatcccgttatcggcaggacagcctcagtggctttgatgacttatgaataaggtatcgtgtcttttttatcttcagaaactgtttgaatgataatcggacgcacaaaacggattaccgcagccgaggccaaaacagctaatccgcctgcaagcaaaaacgcccccgagaatgatccgcttttatccgcgataaagccggttaaagcaggcccgataataccggccgtgtttgcaagaaaatgcataaagccgccgactgacccgacattcctttgatcaaccacatcgtgaatcaccgcccaatagatagagcccgttatatataaaaagaagactgataaagcaacgagaataacggcacttacggcagtggtaacaagtccggcaaatccgatcagtacagcggaagcgaacaggcaagtgacaagaatgactttccgtgagaacaaaaccccttttccggcggtttttttgtatacataatcagaaatcattccgcctgccgccaaaccgataaatccaagaatccagggaataacagtcaccacgctcataaattcaatacttaatccgcgttctttcaccagatagctcggaaaccatgttaagaagaaaaataagatgtaattgtaggcgaaaaaggcaaaagccgtgaagagaaccgttttttgttttaaataaaaggtcatcgggatatgctgctcatgcgattgaaccgccgctttcattgccggggtgtcttccgtctgtgccggccgttctttgacaaatttaaaccagataaacgcccagactaaaccgacgatcatgatcaggacaaaggaaaccttccagctgaatgccacagcaatcatcccgacaatcgggccggaaatcgctccgccgagcggcgtgccgctgtttgtcaggccgatgaccgtggcgcgctgagacggaggaaaccaattgttgaccattttgcttatggcagccgacagcggcccctcgcccataccgaataaaacacggataatcaaaagacttacaaatccgaaagcaagcgcaaccgccccgctgaaaagagaccaaacgatcatcgccgtacacaatgtcaatttagccccgtaccggtcagatgcaacaccgccaaggaagttacacacagcgtatccgacagaaaaactgctgaaaatcagccccatttgggttgcagacaatgtgagatcctgctgtatgaacggcgccgcaatagacagcgctgaacggtctaaatagttaatcaccccggctgaaaataaaagaagaagaatagggaatctatcctttgagaacataaaatccctccctcttatttcataatttaaattgccggagtaaaccggtttatgtaatgaaaccggttatccggattgccttgccagaagcgccggtttatagcggtgaatccgtttttcaccgctatctttttcttgtatctggcaaagaagaaggcttcccgcttttcgcgccatttctgccgcaggctggacgatcgtcgtaatcggaggagtaaaaaaacccgcaaaaggaacttcatcaattccgatgacggctgccttatccgggattgtcatatcatgctccttcatatacttcagcacctcaacaagaacgatatcgtttgccgccaatatcgctttcggaggctcctgaagtgagaacagctctgacaaaacattggaaatatcagccgcatcggctgttttgatatattcgttccgcaccatcatcccgtgggggtcaagcgcctttttatacccttcaatccgctctaccctcggactgatttcccgaataatggacgtcgtaataatcgcgattctcttaatgccgctctcgataaaccggtcaacggcaagaccggctgcatgatggttatcaagcatcactgtcggaatcccgagttcttcaatggttctgtccataaacacgaccggaaacgtatcgcgtttcatcttttcatataaggagagattttcgcccgtcggaaaaataataattccgtccacctgcttggccctgagcatttcaatatatttcttttctttttccggttcatcatccgcattgcagacaataatatgaaatccttgttcatgaaaatagtcttccaccgccctgatgacctgagtggaaaaggtgtgaagaatattagccaccaccacacctaccgtaaatgttgatttctgttttaagctgcgggcgacgaaattcggctgatagttcagctcatgaatggccgcttctattttttgtttcgttttctcgctcatatagtcatagcgctgatttaaaaattgagatacggtgcttttagatacgtttgcatatttcgccacatcagaaattgtaatggttttcatagactcatccccgtctgtcttcatttttcactagtataagtcagaagtaaatagtttacaatctgacagggaactggattctgtcacactcccgaataagccataaaacctccgtcgacgggaacggtgaccccggtgataaagcctgagtatgaatcatccgaaagccacaggagcgttcccagaaggtcttccggtttcccgaaacgtttcatcggtgtatgtgccataatcttattggatcggtctgtcagacttccatcttcctgtaataacaactcacggttttgcgcagtcaaaaagaaacccggagcgatggcattcacccgcagcccttttttcgcgaaatgaacagccatccacatcgtaaaattctgaaccgccgccttagccgcactgtaggcaggcacctttgtcatcggtgtatacgcactcatagaagaaatattaataatcgcgggacattccgccttcaaaaggtcttttccaaacacttgcgatgccagaaatgcaccggtaaagttgcttgaaaatacgctggaaaatcccgtttcgtccatatcaaaaaatgatgggctctgctcatcctcttcatacgtctcattggcagtgatcgcatcagcgtggtttcccccggctccgttaattaaaagattgacagagccgaaccggctgataatctcgtcttttgccttttcgagcgaatcacgggctgaaacatcagccggtacagaaaccgcggttcctccagcatcagcaatctcgcccgccgcacgctctgctttatcagcattccggctgacgatcgcaattttcatcccctgccgtgaaagctcctttgccattgctgaacagagaacaccgctcccgcctgttatgacagcggttcttcctgataaacgtccatgaatcggtctcatctcttcacctctttctcatgagacgagaacgcatcccacagtccgctcaagtacataattcctaaggcacgatcatataaaccatagcccggccggcattgttcgccccagatatgacggccgtgatcaggccgtacatatcctttgtagccttggccgtgcaattcttttaccacaccgataatatcaatggacccatcactggtaagatgcgaagtttccgtaaaatcaccgttatcgcagattttcacatttcgtatatgggcaaacggcgcagctcccgcatagtgtttggcgatcttcaccatatcattggcgggatccgctcccatcgaacccgtgcacaacgtaatacagttggcgggtgaatctgaaatctctcgcagcttttcataacttttctcaccggtgataatacggggcaggccaaaaattgaccaaggcggatcatccggatgaatggccatttgaatgccgtgttcctccgctacaggaaggatttcatgtaaaaagaattctagattggcccaaagctgtttttcaccgaccgtttgataggcttcaaacagttccttgatccgggccattttctccggctcccacccgggaagcgtcaaatcagaagattcttcaaccgtgcggatcagttcttctggagggagactttccactttcgctttttcaaaaaacaaagcagttgacccatcctccagtgcgcggaacatatcagtacgcgtccagtcaaaaatcggcatgaaattgtaacagatgactttcacgccgaattcggacagattgcgaatggtctgtttatagtgctcaatatattgtccgcgttcttcatggccgagtttaatggcttcatgaacattcacgctttccacgacctctgcatgaaacccataggattgaatgaatctgacttcggcttcaatgtcctccttttcccatacttcgcccgcgggcttctggtgaagagcccagacgatgcctttgaccccgggaatttgtctgacatgttcaagcgtcaccgtatcattaccttggccgtaccagcgaaacgtgatattcatgttacacccccgtatattcgttttttcggcagacgtattctttgctgagggatacggcagcttcatagccgcccttttgatatgcttttgtcaagtcgcttcccactccgaccgcgaccgctccggcagaaagccagtcattcatgctgtttaatgagatacccccggtcggcataatgcggacattcggcagagggccgttgaccgacttgataaatgagggattaaacgaattagcggggaacagctttaccacatcacatccggcttcgagcgccaaagccatatcagacacgctcatgcatcccggaagatacggtacgctgtactggttgcatagagatgctatctcttttacaaaatgagagctgacgataaatgaggcgcctgataaaatggcgtgtctcgctgtttcggtatccattacagaaccggctccaagaagaatatcttgatgccggagttccttaaagacatcttccacttcaggagttgtgtatgtaagctcaatggcgctgatacctcctgaaatggccgcttttgaaacttcaagcgcctcttggctgttttgtccccttatgacagccaccacttgtgcatgcagaagtttttcgtaaatggcgtacttaggcagcattctcgctcctcctttaatcaaacgtaatgattgcttttcccaccttgcccgggtgctgttcgatcaactgaaatgctcgatggacgtcatctgctgaaaatgtatgtgtaataagaccgccgtgcgttaacaggcctttattcagtaagtctgtaatgtacggaaactgattcgtctgcaatcttgaaccggtgatcgtgacttccttttttgtgatcggaagctgagaaatgccggcagtcctctcatcaaaaccaagcacaaccacatgaccggccggagacactgcgtcaattgacgtttcaaacgttgaggggagacagacggcatcaatgacgacattagcgccttcattttttgtccattcgttcacccgcaaaacgggatcttctttttgcgcgttgacggtaacatccgcaccgtttttttcagcgaaggccaagcgttcatcattcaagtcggttatcatgacggaagcgcctttgaactttgccatttttaatatgcagattccgatcggccccgctccttgaatcaaaacggtatcttccttctcgacacggcctctccaaacggcctgggcgccgatcgtatatggttctgccatgaccgcttcctcccagggtagatcgggcgaaacagcatacagctgcttttccggaagcacgatatattcccgcatcccgccatcttcatgaacgccgaacaccgaaagcgctttgcagacgttcggacgtcctttccggcaggcatagcatgttccgcaataagatatcggttcaatcactacccggtcacccggcttgaaacgccggacatgagaaccggtctttgcgacttcccctgtgacttcatgtccgattactctcggcagggacgctaacggatttgtcccatgataaatatgcaaatctgatccgcaaattccgacccgattcaccttgacaagaacatcatccgcgtggacaacagacggtttctcacattccgtcaccatcagatcaaatgctttccgtacttgaaccgctttcattttttcacccgctttttaagttgtgcttgctaccgttcaatcacagtctctttgtttacaaatgacagaacctcttctaggcagggaagcccttcattgtcaccggaaactgtggtgacgagcgcaccgactgcatttgcaaactccagacgtttttccggttcaaaaccatgtagataactgtacaggtagccggcattaaagccgtcacccgctcctaccgtgtcgacaggcgcaaccgggaaagcctctttgtgaacccacttatgatcatgatacagcgcagaacccgcttcaccgtcttttatgacaagctgactgattgaatagctctctgcaaaccgggctaatgcttcattttctcctatacctgtcagctgtttcatttcgtcccggcccgccagaagaatatcagtatgcggaaagatttgatgaaatgccgcacgtgcctcctcaatcgtccacagcttcagcctgatattcggatcaaaagatacgggaatctttcttgctttggcgatggaaagcaccctttcagcaatttcaagatttttcttaccaagcgcgaggaacacaccggtaagatgaacgatgtgaatgccgtcaaacatattctcagttatatcttccggtgcaagagtcagaattggtgaattgaaacgataataaaacgtcttgcctgaaccgtcatttctgatctctttgacatttaaagatgtaggaaagccttcaacaaaggagacgtcagtcacatcaattccttctcctttggcaaactgataaatcactctgccgaactcatccttccccagtctgctgacccactttgagtgcaggttcaatctggcgcatgcaatcgcaaaattcagttcagctcctcctgcttttcgttcaaaatgggtaacaaaacgcaaaggtcctgtgcttgcgggatttaaggtgatcatcgcatcaccgatcgtaaaaatgccataatcagaagccacatcaatactcctttcctttaagactaaatcggtttggtaaaccggtttagttaaactttatatgaaagcacttacatatacaagagaaaaatacaataaattcaaaaaaatctgtttccagtaaaaataacccggtttttcacataaaaaacccctcacaacaaaatgtaagggggttttttgaaaattgtatgcatgtttcctcagttagcagtcttacgttcagggcttgtaccttcttcttccgcccatgtttcaatatgcttgagctccggagtattctcggctttgaatacgggatcaagaccttttttgcgctgagcggcataatccttatagatcttgtaggctacattactcagcagtaaaattgccactaagttaatgagagccaagagacccataaacaagtttgccatgtcccagacgatctggaagtcagccaaacatccgtataccaccatcactacgacgaatacgcggtaaatattaagccatgttttgcttgttttaataaattcaatattcgtttcaccatagtaatagttgccgacgactgagctgaatgcgaataaaaacatcgcaatcgcaataaatgtcggcgcccatccgccgagatggtgctgcagtgcggcttgcgtcacttggatgccgtcgcctttaggcgtaacgctgtacaataaaatgataaaagcagtcgatgtacaaacgataaacgtatcaaagaacacgccgagggtctgaattaatccctgcttagccggatgcgacacatgtgcagctgctgcggcattcggcgcgcttcccattcccgcttcgtttgaaaacaggccgcgctgcgctccgataataatgatgcttcctaagcttccgccgacgatctgctcaagaccgaacgcatttttcacaatcgtaacaagcagctcaggtaccgccgaaatatttacaatcacgacatacagcgcgatcagaatatacattcccgccataaccggaacgattaattgcgagacggaaacaacacgcttcagaccgccgaatataatgaaagccgttaatacagctaaaatgattgcgataactgttttattcacatggaatgcttcgtcaaacgccacagaaatcgtatttgactgcaccgcgttaaatataagtccgaaagaaacggtaatcaatacggcgaataaaataccgagccagcgggcgcccagtccctttgccatgtaatatgccggaccgccgcggaattcgtcaccggaacgcactttatacagctgtgccaaggtgctttccacaaagctggaagccataccgacaatcgctacgatccacatccaaaatactgcgccgggaccgcctgttgcaatcgccagcgcgacgccggtcaagtttccggttccgacacgagaagctgctgagataaagaatgcctgcattgaagacactcctttatttccttgcggcttctccccgacgattctgaacatttcaaaaaagtactggaattgaataaagcgaaaacggaacgtaaagtacaatccgatcccgactaaaatataaacaagatacttccaaataaaatcatttggaacatttatgatttcactgatgaaagcctccatgtttaacctcccttttacatatcttttactgtcatttttgctgtatatgttagatcttttaacacaacgggtattattatatcacaacaacagtggttgagaagtttttttaagaaaatgtttcggtttcttcatcacatcttttgctgtcatgccccgttttttatcttacagcctgaaaaatgttgtcacgttataaggaatgcgtgcatatcataacaaataggtctttaagaaaaaagagatgaaaagatggatggaatggtatatacttaaccaggataataattttttaaatttaataaatgtgtttactttacatttaaattagggtattataataaaaatattcagacttatgaagggaggagaacatttgaaaaaaatcttgtttttaaaagcttctattttatttttagcgattgcaagctttcatttgctctccattccccatgcgtttgataccgctcatcattttaaagcggtagccgaccagcaggaaatgcacgaaatgaaggccggccaaaatgctgatgatgagaaaaaatcgctgacgggctcatatatcttgacggcgctttttgccgcttctgtctcactgattgtgatatcagacaggagacgccccgcttcccggagaagacagcgaaagaaaagctttttaatcgctaaattttatcagtcctcgtatttcgatgagcttcatgttcaacatcgcctatctatgtaacataaaatgaggaggttgttaaacatgttgtttatcttacgaatggtgattttagggttgttttcattcactgcattgaatttatttgtatggcagggaatcgaagtcattcacgctatcactgacttattcggcagccatgaaagctaaatagtaaaacctccgctcaatgagcggaggttttttattttatttttactcttaaacatcgtatgcagggatacgccatacatctgttaccggccctgtctcatcttcatcggtaaagaaggagccgttgctgtatcggtcattcgcccgcaaggacttcacggcgatttcgattctctcgcctttttctgtttccgcagcgatcatgtcggccaaagcgcacgcaaatacgccgactgcccgatgcgggttcttttttagctcacgcagcatgatgacaccgcgtttcgccctggatgttttttcgaattcagataggttcatccgtttgattgctccccgctgtgtgacgaggacaagcgaatctgtttcatgcaggatttgccctgatacgacggtatcaccgtcttttaaatttatgccctttacgccggccgcacgggcaccgactacatttacttcatcttcaccgaaccataaaccgtacccgaggcgggtggcgataaacagctggctgccgccgtctgtgacatgaacatcaatcagctcatcatcccctttaaggttaagggcaacaagcgctttcgagtaacgctgcgctttgtaatgcgtcatttcagttctcttcaccataccgtttttcgtcatgaacagtaaatatgaagatggatcaaattcttttaccggtatagctttcacgatggtttcatcacggtcaatcgtgatgatgttcgttacgtgctgccccatgtctttccacctgatatcgggaagctggtgaaccggacaataaacatagcttcccttattggtaaagagcagaagaacatccgttgtattcatttcaaattggtgaatcagcctgtcagtatccttcataccgaaatcctggccgttagaagcggcaaatgaccgctggcttgttcgttttacatagccgtcttttgtgactgtcacatatacgtcctcagaggcaaccatgacttcaagattgattttaatttcctctatcttttcttcaatgacagaccgtctgctgtcagcataggtctttttcaattttttcaggctgcttgtaatgacttttaacagctttttatcatgacttaaaatggcttcgagctcctgaattttcttgctgagctcttccgcttcctcttttagcgccgtaatatccgtgtttgtcagacgatacagctgcaaggatacgatcgcttcggcctgcggctccgtaaatgcgaatttagaaattaagttttgtttcgcatctttcttgtcgctgcttgcccggatgaccgctatgacctcatctaacacggacagtgccttcatcagtccttcaacgatgtgatgccgctcttttgctttttgtaattcaaagacggagcggtttgtcaccacttccttctgatgggaaatatacgcatccaggatggccgtaagactcatcagcatcggccggcggttatgtatggcgaccatattaaagttatatgttgtctgcagatcagtgtttttatataagaaattcaggatgccttttgcatcggcttctttctttaactcaacgaccacccgaagccccgtgcggtcagtttcatccctgacttcagaaatgccttcgacttttttgtctatgcggtattcgtccattttcttaacgagattggctttgtttacttcaaacggaatttctgtaatgacgatctgctcccgtccgcctcttacggattccacttcagccttgccgcggataataattttgcctttaccggtttcataagccttccgaatgccgtcgactccttgaataatgcctcctgtcggaaagtcaggccctttaatcacctgcatcaagtcatcgacagtgcaatccggagattcaatccgtttaatgacggcatcaatgacctcacccagatgatgagggggaatatcagtcgcatagcccgctgaaatcccggttgatccgttaacaagcaagttagggaacatggcgggcaaaacaaccggctctttactggtgtcatcaaagttcggaacgaattcaaccgtatttttatcaatatcacgcaaaagctctgacgcgatagaagataatctcgcttccgtataacgcatggcagccggcggatcaccgtcaatgcttccgttattgccgtgcatctcaatcagcacattccgcactttccaatcctggctcatccgcaccatcgcttcataaacggagctgtcaccgtgcggatgataattaccgataacgtttccgaccgtttttgccgctttacggaaatttttatcgaatgtatttccgtctgcgtgcatggcgtataaaattctccgctgcaccggctttaaaccgtcacgagcgtcgggcagcgccctgtcttgaataatgtatttactgtagcgtccgaaacggtcgccgattacttcttctaacggtaaatcatgaaataattctggctgtgccactattaaacctcctcagcgaccgacaagttttcattttccaaaatattgctttcctcatctaatccgaaggcaacattcttttcaatccattttcttctcggttctactttgtctcccattaatgtcgttacacggcgctctacccgtgccgcatcgtcgatcttgactctgacgagcgttcgcgattcgggattcatcgtcgtttcccagagctggtctgcgttcatttctcccagacctttatagcgctggatggtatatcctttgccgactttctttaaaacgccgtccatttcttcgtcggaccaagcatattcaataatctctttcttgccgcttcctttgctcactttgtaaagaggcggaagggcgatgaaaacttttccgtgctcgattaaaggtttcatatagcggtagaaaaacgttaacagcaagacttgaatgtgcgcgccgtcggtatccgcgtccgtcatgatgatgatcttgtcatagttgatgtcctctatatcaaaatctgcgccgacaccgccgccgatcgcatgaataatcgtattgatttcttcatttttgaagatgtctgcaagctttgctttctctgtgttgatgacctttccgcgaaggggcagcacggcttggaatttccggtctcttccctgttttgcagagcctccagcagagtctccctccaccagatacaattcattcttcgccggatttctggaaccggccggtgtgagttttccgctcagcgtcgcttctgattttttgcgctttttgccgcttctcgcttcttctctcgctttacgggccgcttcacgggcctggcttgctttaatcgcttttttgacaagcagggttgccgtatcgcggttttcttccaagaaataagcaagattctcagaaatgacggcatccgcggcggatctcgcctcacttgtgccgagcttccctttcgtctggccttcaaattgcagcagttcctccgggatacggacggaaatgattgcggacaaaccttccctgatatcggcgccttcaaggttcttgtctttctcttttaaaagggcgacctttcgcgcatactcgttaaacgctcttgtcattgccgttttggctcctgattcgtgggtgccgccgtcctttgttctgacgttattaacgaatgacagcatattttctgaatacccgtcattaaactgaaacgcgaaatcgacttcaatgtcatgatgctcgccttcaaaggacaccacttcgcataaagcgtctttttcctcgtttaaataagcgacaaatgcttcaattccgttctcataataaaatacttcttttacgcctttccgttcatcaattaattctattttcaaaccttttaacaagaaagccgattcgcgcagacgttctgacagcgtgtcaaaattataaaccgttgagctgaacattgacggatcaggtttaaaatgggtaagcgttcccgtttttttggtcgttccgattttttcaagtgaagtcacgggcttgccgccgttttcaaaccgctgtttatagacatatccgtcacgctcaatagtaactgtcagccactccgataatgcgtttacgacagatgcgccgacaccatgcagaccgccgcttgttttatagccgccctgtccgaatttccccccggcatgcagcacggtgaaaataacttccggcgtcggctttccgagcttatgcatcccggtcggcattccgcgtcctctatcctgaacggagatgctgttgtccttatgtatcgttacgataatatgatctccgtagccggcaagaacttcatcgacggaattgtcgacgatctcatataccagatggtgcaggccgcgtgcgtccgtcgaaccgatgtacattcccggtcgttttctgacggcttccaggccttcaagcacctgtatggcatcttcgttgtaatcaaattgctgttttctagccaaacgtacaaacccctttcaaaaaacctgctcttaatcattctcttttttaaatgttttcatgtctttgtttttcagtatgcgcaagcttcggtccaattctcctcggactcacaattataaccaatatgcttgatttcgcaacatatttaagcgaatggctcgttttttaggccgcaagacatacattcgaacggcttttcatctttttggtgcccttttcggcagataagaacatgagttcgctttctattatatagctttatgccggccatcgcaaacagactgcaaacccctgtataaaggggtttctaaaaaagctgttcatgctttattgtatctgtttcatcatcatacgcaaagagtattctttcaataaaaaagcaaaaacccctgatttgccaaggatttttgccttttttgttcctattttataacagcgcgggcgacttttatacataaatccattacagccgtccgtcctttgtctgtaatcatgcgatacgcttcttcatttgcaaggccctgctgcgcccaaaaaacgggagcgtccgtctgtaaaaattcttcagcaacgccgggaagctgctcagagcgtctgaacacattcacgatatcaatcggtccctccacgtcttttaatgaagcaacggctttaacgccaagcgcctcatcaatcgttgggttgacgggaataatttcatacccttcatcctgcatcgctttggaaaccatgtaagaagtccggtcgggacgatctgacagcccgacgaccgcgatccgtttgctccggtccagaatttctttaatctctgattttgaaggattttgcatctttaccatctccttttgatatattgtacatgaccgcttcgccggaatcaaaaaaagcgatttgtcagcttaattctcaaaaaacttgtcatcagacggtaacaactcgtgttaaaatagagtgaagggacattgaaaaggagaaatgtagatgttgattgctttattgattattttggcctatgcaataggcagcatcccgtcaggtttagtcgtaggcaaacttgcgaaagggatcgatattagagaacacggaagcggcaatttgggcgctacaaatgcttttcgcacgcttggcgttaaagcgggatctgtcgtcgtcgcagccgatattttaaaaggcaccctggccgcggcgctcccatatttactgcacgtccccattcatcctcttctcgcaggggtggcagcagtgatcggccatgtattccccgtgttcgcaaagtttaagggaggcaaagccgtagccacatcagggggcgtcctgctgttttatgctccgctgttattcgttacgatggttgcagtatttttcgtatttttattccttacgaaatttgtttctctgtcttcaatgttaacagggatttatacgattatttactgtctgtttgtaaaagacccttatttattaatcgtagtgacgctcttgaccgcgtttgttatctacagacacagggcaaacatcaaacggattataaacaaaacagaaccgaagatcaaatggttttgatgaaacttcaattttgacatcaaaatgccatatgcgtttataatagagataatttctttatatgagaaacaaaaagggagtgttccggatgaacatgaaagtaacgaaaggcgcgctggattggtacaaagaagagctcgatctggaaacaggcgaccatgtccgtttctttgtccgttacgggggatgcagcaacgttcagaaaggcttttctctcggcattttaaaagacctgccgatgaacatcggcaccagcacggaagttgaaggcattaccttttttattgaagaaagcgacttatggtactttgataatcacgatttgtcagtcacatattcagatcaggcagaagagccggtatttgattacgtgtaaaaaaaagaacgcagcggatgcgttcttttttttacagcctgaacctttttaggtgatcagtcagacgttctttttctaatatgcttctttgcgtttctccgagcaggtcaaagtggggaaattcatttttatggtgaatccactccggcttcagcccgtactccgctccccatctgatcagtttattgagatcgcttgaaccggccttcgtcacggtcttagcctccggaaagcggtcgtccagccagtaatgcgttaaaaaagcgattttcccttccgatacatcctgcttccatctttccagttccttacgcgtaattccaaatgccataagtgcagccgctccttatttttttgccttttcgtaagcggcatgccaatcaggaaaagccttgcgaaactgaatcggtttgaagctctctttatcaacgcatatatgagaggatgtcgctttgatggcaagttcttgatccggattatagatgtggtagccgtaaacggttttaaatccgttatattcttcaatccaagtatgtacgacagccgtttcaccgtagcggagcggctttttataagaaatgctgatatccaatacaggggacagcactcctctatcttccatatccttgtaaaggaatccgagttccttaatcagcgccgttctgccgacctccatccagactaagtaattggcatgatagacgatgcccatttgatctgtttccgcataacgcacttctatttctttttttgacacatgcaacgttctctgctccctttttatcagattagccccattttatcacaacgagccggaaagagaaaaaaaccaggtttccctggtttttattatgattgatagccgttttctcttgcagccgattcatcctgaatttcactgcggaacgattcaatgctttcattgcgtctggcattcttttcttgaatgcgctgtttttcctcatctgtcgcaaattccattgattctttcgcttcttctatattttcaattgtattctgcaccatatcctgcagcttttcaacgttatcggaacggtcatccggattcggtttttgatcattgtttgtcataatgtctgctctcctttgatgatgttattcgcctttcgtctgcatgacaatcggatgtccgtttgacttgtcatgaaacttttcccctttgttgcgtttatatttaacgggttttgtccctaagtggctcggagcgtattgcggctggccgtctttcttgtttatgcccatgttcatccctccttaagagtatattttgcaaaaggaggtgcaaacatgactgcaaattaaaggttatttttgtttgaaccgctgctccagcttttcttcaagctgattcaaatattccgtattggtcatcagctcacgtttattttccataaccaattcatgaaaagaacgttttcgcatttttttcaatcttctcacctccgtgttttcattcattttttccaatttttcaaaacctaagcccttcacaataaaaaaactgaacctctatttgagatccagtttttctttcatttctttttttgtcatcgtgcctacgcgaatgtgctgaatggttcctttttcgtctaatatgtatgttgtcggataagaaagcacgttgaaatccccgttaattccgcttttgtcaatcagaataggaaaggtcagctgataatgatcagcaaatgatttcacagcctgtatatttttttcagaagacgtaaaattaacggctgctaccgcaatatcaggatattctttctgcagctcctgcatatccggcatttccattcggcacggcttgcaccacgtcgcccagaaattgaggagcactttttttcctttataatcagatagggagatactttttcctgacaatgtatcaagtgtaaagtcaggggctttcatcccttcttctgtcccttctttcggacttttttgcacggaataaatgttccagcccgcatatactaacaacccgataagtaacattccgcccagccatttcgcaagcatcttaagcctcccgcataaaaagagagaaagcagactgctttctctcttttgttcattctgctactgtttcattttatcgcgaagcaccatttgtaaaatgccgccgtggcgatagtaatcaatttccacttcactgtcaaaacggacaacgacttcaaacgtttttaccgtaccgtcttcactgattgctctgacagtcagcaagtcgcgcggacgtacagattcatcaacatccacctcgatgacttccttaccggttaagccgagtgtatccgcgttttcgccctgtttgaactggagcggcagcacacccatgaagacgaggttgcttctgtgaattctttcaaagctttcggcaatgactgttctgatgccgagcaggtttgttccttttgcagcccagtcacgtgaagagcccattccgtaatcttttccggccaggacgacaagacccgttttatcttctttataccgcatgcaggcatcataaatagatgtcacttccccggtaggccaatgtgttgtgtagccgccttctgtacccggtgcgatttggtttttaatgcggatattggcgaatgttcctctcatcatgacttcatggtttccgcggcgtgagccgtaagagttaaagtcacgaggagaaacgcctttttcctgcaggtatttgcccgccggtgtgtcttttccgatcgctccggccggagaaatatggtcagtcgtcacggaatcgccgaatttgccgacaacgcgaagtcctcttaaaggctcaacttttcccggctctacagacatttcctcaaagaatggcgggttttgaatgtaagtggaatcctggtcccacttatacagcgcttcatccgtcgtttcgatttcgttccagcgctggttgtcgtcaaataccgtttcatactctttgcggaataattccggcgtaacagtctgtttgacgagagaattgatttcatccatggacggccagatgtcatcgaaataaacattttgtccgtcatttccgacgccgatcggatccgttttcaggttgatgtttacagttcccgccaatgcgtatgcgacaacaagcggcggtgacgcaaggtagtttcctttgacaagcgggtggatccggccttcaaagtttctgttacccgacaggacagaagtgatcaggaggtcatttttagcaaccgcttcttcaatctctggagaaagcgggccggagttcccgatacatgtcgtacagccataccccacaaggttaaagccgagctccttcatgtaaggaagcagacctgagttgactaagtatccagtaacaaccttagaccccggtgcaagtgaagtcttcacataattcggcactttcaagcctaattctaccgcttttttggctaccaatccggcaccgattaatacataagggtttgatgtattcgtacagcttgtaatagcggcgattgcaatcgcccctgttttcataaccgcatcttcaccgctgttaagtttaaatgaaatttctttgttctcttcagcagcatccgctccgaatccttggttgccggccgggctgacaagatgttttttaaacgtttcctgcataacggaaagcgggattaaatcctgcggacgtttcgggcctgaaaggttcgcttcgatttttgacagatcaatttccacaacgtctgtaaaaatcggctcttccgcgtcaggcgtatagaataaaccgttgctgcggcagtatgcttccacaatatcgatctgctcttcttcacggccggtcagacgcaggtaagaaagtgcttcctcgtcaaccgggaagaatccgcaagtcgctccgtattccggcgccatattggcaatagtcgcccgatccgcaagcggaagctcagcaacaccaggaccgaagaattcaacaaatttattgactacgcctttttcacgcagcacttgagtgactttcagcgccaagtcagtcgccgtcgttccgttaggcaattttccgacaagtttcgcgccgatgacctcaggaacagggaaatatgaaggctggccgagcattcccgcttccgcttcaataccgccgacaccccagccgaggacgccgattccgttaatcattgttgtatgggaatcagttcccaccaaagtatcaggataggtcacaagttctccgtcttcctctttcgtatggacaacgcttgccaaaaactcaaggtttacctggtgaacgatacctgttgcaggcggaacggcctgataattgttaaacgctttctttgcccagcttaaaaatttataacgttctgcatttctttcgaattctaagtccatattaatggctaacgcatcttccgtaccggctttgtcaacttgtacggagtggtcaatgaccaggtcaaccggaatttcaggattgattttatcagggtctccgccgacagaggccatggcttttcttaaagatgccaggtcaactacggccggaacgccggtaaagtcctgcagaataacccgtgacggtttaaacggcacatcgatatcttttaattcagcagtaccccatcttgctaaattttcaacatgctcttttgtaatgacgcgtccgtctacctgacgcaaaacggattccaaaagaaccttaatagaataaggaagttttgaaacattgccgacccctgcgtcttccaatgcttttaatgaatagtagttgtatgttttcccatttgaagaaaatgtttttcttgcttggaaaacgtcttgtgttgcgactttttgctgatttgtcattctccaaaatcccccttcaatgatcaagatcgttctttagatgaatgttcacattccatcacaattttctcacaatttcatcttagtataaaatcatacataagtaaatatcaatgtttttattaaatacaataagatcgtcttatcagcatattttcggtaaattttgtccgattttccgcctcatacaacgggctgtaaagagccatattaatgttgaggtgatgatcatggtaaaacggaaagccaatcatgtaattaacggcatgaatgatgcgaaaagccaaggcaaaggcgcgggttatatagaaaatgaccagctcgtcctgacggaagaagaacggcagaacaataaaaaaagaaaaacaaaccaatagccggaacaccttaaaaaggaggctttaacatgacaaataaaaatacgagtaaagatatgcataaaaatgctccgaagggccataaccccggccagccggaaccgctgagcggaagcaaaaaagtgaaaaaccgcaaccatacaagacaaaaacataatacaagccacgatatgtaaaacagaccccggtgtctgtttttttgtgccattcacccatttaaagcttctgcatacgttatagcaaggctttttaatatggaggaatgcttccatgaatcactcaaaaaacgctgaagaatttgatgatacggaagaatggctgcggcagttttacgaggacccgtatgcttggtatgacgagacgctgccgatcgatctatatgaaacaagccgtcagtatatcattgaagccgacctgacggccctgaagcaggtgcaggcgatcaccgtcactctttcgggaaatgagtttatgctctctgttaaaacgcttgaacggacattaaacaaacaaatggtgcttcctttttatctgaatgacaaacatattttcactgatttcaccaaccatattctgaccgtctccatgaacaaggagcctaatgagactcctgcctcattttcctttcaatttcctctataacataaaaaagccgctttcatccctcaatggaagcggcttttttgtccggtcatatcagtcatataccctcaaagtgaatctcccatggccaaatagcagaatcactatacgatagaatatgttctagcaaccgaattgactggacatctatcattttttctattctttttttcatgtgttcttctattctgtcttcgtttacaatatggttaaagtaaggaggagatagaacaatgctagaaggctggtttatgtggtttattttattttgggtcatcgtgatgatcggattgctgtctatcggcggattttttatgttccgaaaatttttaaaacgcttaccgaaagaagacggccggtcagaactggattggcaggactattatattgaaaaaagcaggcacttatggaatgcgggtgacaaggcgtttttggatgaattggtcgctcccgtgccggagctctttcgggatgtagccaaagcgaaaatcgccggaaaaatcggtgaactttccttagcggaggaagctgaacaaataaatcgtgatttaatcatcaggggttacatactggccactcctaagcgtgatcatcaatttttaaaaaagcatctccgcgaaaaacagattgatcttactccttatcaggccctgctcaaataaaaaacctttccggcggacggaaaggttttaattcatctgaatatcagcggtcttcagttcattcgaaagtttgcggtaagacataaacatcgcgatgcgccacggaacaatcattccgaaagccagaatccaaaacattccgcttaaagctccgtaatcaatcgtcgtgctcaaaatggatttcatagcgattctgataaccagcaaaccaatcaggataaacacaaacgcttttgaccgttttaaatagatttcattatttttaatctcaaatttagatgttttaatcagaaaaatagagaagatcacgcccagcgtaatggcctccaaaaattcttcgcccgtcactctgaaaatcggaaaaaggaacataagcgctcccgtactcatgaaaatcggcgggagaattatttttttaggtgaagcgggcttgtcggaggctttaatcctgacgatcatcacggaaatggccatggccgctgcaataacggatgaaattataatcatcatctttatcattcctttgcttgcacggagtttgatactatatactatactccaaaaacataaaaaaaaccaatttgaaaagagaacacgtttacgttcccgttacccggcctacggcctccagcactttagatgcttcaaacggtttaacgataaagtctttagcgcctaattcaatcgcttccagaacgatccgctgctgccgcatggcggtgcacatgatgatccgggctttcgggtcaaaagctaaaatatcctgcagcgcctgtataccgtttttgaccggcatggtaatatccattgtcaccaggtcgggacggattttttgatatactgccagggcttcctcgccgtcagccgcttctccggccactgtgtaattcgccgtttccagaatctctctgattttcgccctcatgaacttggcgtcatctacaactaaaactcgtgtcatattcccctccacatatttaacattaactagtcttattgtaccaaaaacgaaagggtatataatagttcaaaagttattaatccgttacagacccgtaaatcctccgaaaagatttgacagaacgatcagaatgtagctcatccagttaaaaaacagcataactccgatcagaatcataagaatgccgccgattttcatgataagcagctgatgcttgcgaatccaattcattctggtaataaaaaatgaaagaacaagaaaaggaatcgcaaaaccgagaacatataaaaacatatacggcactgctgaagaaggatttgtatttgccagcgaaaacacggctcctaaaataggcccgctgcacggcgaccagccggctgcaaacgcaagaccgatcagaaccgaaccgataaacccctccggacggcgcttaaagtgaatgcgccgctctttcatcatgaatttcggctgaaacacaccggcagtaatcagcccgaaaagaatcagcatgatagcgccaaactggcggatcgcttcatgatattgggtaaaaaaactgccgataaacgaagttccatatcccaatgcgataaaaatcacggagaagccaagcaaaaaacaaagtgtatgcacgaggccacgcttttgcagcatcaccttttctgttttcacctcgtccatactgacaccagttatgtaagataaaaaggcggggtacaacggcagacagcatggagaaatgaaagacagaaatccggccccaaacgtcagaaagtaattaaaactcacgatgacacactcccttcgagttatgacaaaatcatttcatttttttaacactttcccgagaaggattactttttatagaaaaagcttatataatttaatttgacatcgagatattatactccttcttatttgaaaaacagtataaatgtggatataataatagcgactcaggtgaaagatttatgtatgaaaggatatatccctgtgattagagagcatctattaaatgaaattgaaaaaaaacgggcagagctgcttaaaatcgtcatgacaaacggaatgacatcaaacattacgatagaactcagccaggagcttgaccaccttctcatacaataccaaaaagaactgcacaccggcagttggggtgaaacatgacgcaaaaataaaaaaccctctccgggttttttatttttataaccatgtatctctatatcataatctgtacgtattatttcgcttgattattcatggctttcatcatttgattaattttcttttgagaaggtttcattcccatttgcatcatcatcatgcgtaacatttgttcattaataggcggattctttttcaaatagctcatcatatatttacgagcaataaaaaacccgagtgcaacacctatgagcaatgcgacaacgcccactaggatgccaacccataaagtcattttatttcctccttcatgttgtctagtttaaagtgtactaaaccaaaggctattatacaacatttacatctctttttcctcgtttttagacaaaatttctttccctgaccggatttaaccacccgtagcgccgtgtcttgaaatccattgcaagaaaacaggggctgattttacgcagaatctcaaagaaaatcgtttccgcctcataatctcccgaagccgcaatctcaattaaactgtctttcatcatgaaggtggcgcggcccttttctccgggcagtgtaagccggtaaatggaatccaaacggctgtaactcattcggtttaaatgcagctggagccgctgatgcatatgtatcaccggaatcggttccgttatatattgaacttgcttttctgtcatttgatattcctggggtgtcagatctgtccaatgatagtctcgaaacaactcaaacatagccgtttcccgcccgaagtagtggttcgcaaactcatcctttatcaggtgcgtatagtaatgacgttccatttcctcatccccttttacagcgcttcgttattgctttctattatacaaaaggagaaaagaaagaattgtctattactgttacgccgccccttctatttttgtcgcataaacaggaaaaagaggatgatttgactcatcctcttttgtctcgttatttgtttagaagttttttcacgcggtcaactacgttttctgcagtaaacccgtattctttcataattgtttctcccggagctgaagcaccgaaacggtcaattgcgagaacgtctccttcaagaccggtaaatttgccccatccgaagcttgaacccatttcgatcgcaagacgtttcgtcacattcggaggaagcacgctgtttttgtactcagccgattgtttttcaaagcggtcccagctcggcatgctgactacagatacgtgaatgttttcttcagccagtttcgcttgagcttcgatcgcaagtccgacttcagagcctgtcgctaaaagaagggcgtccggtgaatcggtttttgctttggaaacggtataagcccctttttccacgcccgcatacgcttcttcagcctgctgatcaatcgtcggcaggttttggcgtgtcaatacaagagctgtcggatgatcttggctttgaacggcaaccttccatgcagctgcggtttcatttccgtcagcaggtctgatcacagaaaggttaggaagtgcgcgtaaagaagcaagctgctcaatcggttcgtgagtcggcccgtcttctcctacggcaatactgtcatgcgtgaatacataagtgacagggagtcccatcaatgatgccagacgaatggcaggtcttaaataatcagagaatacaaagaatgtgccgccgaatacgcggaggccgccgtgaagcgccattccgtttaatgcagcgcccatcgcaaattcacggacaccgaaccagaagtttttcccggcgtagtctttggccgtgaagtctcctccatttttgattgtcgttttatttgaacccgcaaggtcagcagatcccccgacaaagaaaggaattttcttggcgatcccgttcagtacctcacctgaagatgcgcgggaagcaaggctgctgcctttttcataaacgggaacttcctgatcccagtctttaggaagctcgcctttcatgccgagtgacagctgttcagcaagctcaggatatttttctttataagccgcgaacagttcattccattcctgttcttttttcgagccggcttcttttacagcttgattgaaatgcccgtatacttcttccggaacataaaaatcttcttcaaacgtccaagcatacgcttcttttgtcagcttgctctcttctagtcctaacggagcgccgtgaacgccggatgtgcccgcacggtttggagaaccgaaaccgatcgtggttttcacttcaatcaaagtcggttttttatcattctggcgcgctttttcaattgcagccgtcaattcagcgatgttgtttccgtcctcaacataaagaacttcccagttcattgcttcaaaacgctgctttacattttcagagaaagatcggtctaaatcgccgtctaaggaaatgtcattagaatcgtataatacgatcaggcggcctaattcaagatggcctgcaagagaagcggcttcggaagaaatgccttccattaaatcgccgtctccgcaaatactgtatgtataatgatcaactacgttgaatgaatcacggttatatgtctcagccagatggcgttctgcaattgccattcccactgccattgcaatcccctgtccaagcggcccggtcgttgcgtctactccggctgtatgcccgaactccggatgtcccggtgttttgcttccccattgacggaactgtttcaagtcttcaatgctgaggtcatatccgcttaaatgcagcatgctgtataaaagcattgaaccgtggcctgctgataaaacaaagcggtcgcggttaaaccagcccggattctgcggatttacattcataaatttcgtccacagcgtgtatgccatcggagcggctcccatcggcatgcccggatgtccggaattcgctttttcaattgcgtctatagatagtgtacgaatggtggcaactgatttcttttcaattgtatccattataatccccttccttattgttgtaccttttcatcataaagcgatgctgactttttctcaactctttcagcttaaatttgagataaacttgttgaaaattgtcgtaaagcacatcctgatattagtatatacgaaaaaagaatacgtattgccgtattctttctgtttagtgaagattatttttctgttgttctctttttaatttttcaggggtgacatcgttgccttccggatcaatcacttttacgctctttaacgtatttttcattgaggagcggaatcctttcaaatactcctggcgaagcttttgctgttcagctttttcctcatccgttattgtgtttgatttagctttttgagccaattcgttaattcttgcgattttttctttagaaatcataataagctcctttggtgcgtgttgattatatactactaaaacgcagtcttttttacaactgatgcgcgtcagctgccttctgtgtctgcggtatattcctgaaaccgccggtgaaccgtggctttggacacgtcatagccgaatcctcttaaggtcgctgcgatttctgcaaaggtaagcttgttggctctcagcctgataatttccgaaaccggaacctcttttttttcttttccgctgttttcatgtctgtttttcagattccgttcaggcttgtagccgtttttcacggctcttttcattccccgccggattttcatattgtgaattttcctctgatattcctcaacaatactgacgatttcaagtaccatcgaatcagcttcggaaagctccagttcacctttatgagccgtcgtatatattttaacgttctccctgtaaatacaatgcaaaagcgcaatcttggcgtttcctcttcccaatctcgtttcgtcctgcaccaatatcgcgtcaatatgtgattttttaatttcatcaagcatttcaaatactccgtcgcggtccatttcgtaaccgctggctttctcagaaatgactttcacgacttccatgccgtttgcagcagcgatctcactgagctcctcttcctgtctttttaatgacgtttgctgctgttctttgtttgtgcttacgcgggcataaatgagcgccttcatttctctctttcctctctaattgacaatggccagctgatatacggccggatgcttcttcttaaccggtagaataagttcgtctccgggctttatatcagcagtctggagatgattattctccgtcacccactcaatgaaatcttctttattaatgtgtttcttttctgctacatgatctgcaagtgaccagagtgtatcgccgtcctgaacctttattttaacatattggctgagggactgatcatttcccgcacatgaaacaagtaaaatagcggcacttaaaatcgcagtaaacagcccgacaaatatgatagattctttcgccatgtaaacaacctccgataagaatgtttgttcgctttttatatctttcagtatatacgaacaaatgtttctgtcaatcgtttttttcgaacctatgtttgtactgtcaggaaaatcatgctataatctacttaaaatcgacgttttgaggtgcgaaatatgacgaagctatcaaaaaggcagcttgatatcctgcgttttattaaagaagaggtaaaaacgaaaggatatccgccttctgtaagagagataggagaagcagtaggactggcttccagttcaaccgtgcacggccatttggcgcggctggagacaaaaggcctgatcagacgggaccctacgaaaccgagggcgattgaggtattggatgaagaagaagtccatattccgaaaagccaggtcgtaaacgttccggtcatcgggaaagtgacggcgggtattccgattacggctgttgaaaatatcgacgagtattttccgcttcctgaccggatggttcctccgggcgaacatgtctttatgttagaaatcatgggagaaagtatgattgacgccggcatttttgacaaagattacgtcattgtcaaacagcagaacacggccaataacggagaaatcgtcgtagctatgaccgaagatgatgaagcgacggtcaagcgcttctataaagaagacaattatgtgcggctgcagccggaaaatccgacgatggagccgattatcctgcaaaacgtaagcattttggggaaagtgatcggcgtattcagagccgtccattaattctattaaacttcatttatcgtaaaaaacccctctgtaaggggtttttttgcataaaaaaagcagattcgccctggcttaagaaacgaacctgctaaggaggaaaaacttacattcttattatccgacatcgcacttttgaagtcaactaataatgtttccctcgagaaacttttcattcatttttcaactttttatatatttgtgcgtgatgaatttgcttttttatcttttctttgggcgggcacgtcaaaaaatttatatatgaatatttagtacatagtgcaataagttaaatataaatataaaaaaacccgctgcctttagcgagtatctattttcaatcaaaatgataatattctacaccgtagaaccctttaatatagacgggaccacagacgtttgaagaactttcaaccagaatcctgtatttgtgatacggatcaattgattttttatcttgggcactgaggtttaaccagctgccgctgtagtttttagaacttaatgtataaaaatttccgttcagcgccatccgctggagtttcatgcttaaaccgcacgaagagttgttcattatggtgaacttatagcctaaaaagtaatcgtcggcagctacagcacccggattttcaatatgaaactcttttgcgtttccctccaaagtgaagcttgtttttgatccgaattcagtggtagccgctttagctgagtgtattccgctaaaacataataaaaaaacagcaatacatatccagtattttttcatttgcatccccctttttacatattttaacttgtgaatcctgtgatgtctattcacattttactttataaccactatatacctgtttaaaaatttgcggattgcttacaatgaagactaaacgaaataacgaaggtggttcaaatgaaacacgtaattgctttcgcttctaaaacggcgctcacacttgctttactgtacattgttctggatcttatgtaccaagtaacctttttaaacgttctgtttattacagtgatcttaagtttaatcacttattttgcgggtgattgcatgattctgccgagaacaagcaatttcacagccgttgcagctgatttcggaatttcattcattatattatggatattcctgatgaacattggcgggtttaatgtctctcctgccgcggcagcggttatctctgcactttgcatttctgtttttgaggcattttttcaccggtatttgcagcaatatgtacttcccgaagattataaggacacaacagagacggatagcacgctatggagctatcaaaccgaggcgtctgaagaattagtgccggaaaaagaccctcaggaaaaaacataaaaaggaggcaatcgcctcctcctctttttacttttgcttctgatcgtcaagcggcagctgcagcagtgagtctgtgcctgtcgctttcggcgtttttccgtcccatttttcaatccatttatatttgatcatttcatcggacattgatttcttaatgatttcgttatagtcagcgatcccttccgcttcaatttttttctttttcgcttcggcttcggctattttaatttcagtttgtgtccgttcaagttcctgtgaagacttcacccttgcatcgatggcttcctgtgtggctttatccggcttcggtacgccaagcgtcagatcatcaattaaaaatccgagactcttcatatcatcagcaaatctcttttgaacatcggccgcggcttcagcagatttttgcccgtatgtgtcaataaccgagtatttgctgattgattttcgcgccgcatcccacagccttgtttttaaatatgtattttcaatcgtttcgacgtctaccgccccgaatttgttaaacagatcgactactttatcaggctgcacgacatagttgtaagcgatatccatttctatatttttaccatcagaggttgccacttttatattttcattattcactgtctgcatacgcaccggatattccgttactttattaaataatccgactaagtgccagccttggtccaatgtgtcggattttaccccgccattcggtgagtatacaaccccgacataaccgttcggtattttttcaatgaatagtgacgctgtgacgcccgcaattaaaagggctgcacctataatcacaccgccgagaattttttttgtgtttccgcgcttattttcgctcatgctgatcttcttcctcccatgacttttttaattttttggctccgcttcccacttgtttaaagattggactaagcatcagccataaaccgaatccgatgatgacaagaagaatgatagacccgatcatcactttcatttgcccacctcttttctttcatcctgtcaattatgtatacgatcttaagaacttaaagtttcataaatttcaaaagaaaaagccccgccgacaaaataagcgtgcttattaataattgtcactgataaaatcagaaatcgtttttgtaaattggtaaaaggtcccgttttgtgcggatgctctgcttttcagcgtaaaggtgtcaaatagtgattttctgaagccggtgctcatttcgatttgaatactcaatccggatgaagattgattggcaaggttgttcggactgacgcctgcgtatttatcatttgtgccaagaagaacggcaggatacccgtgccgtttcagcacatcggtcaagagttcggcccgttctctgtctgtaccgccgatttttatctttttatcatcactgccgtaaccgtgcaatgaaatgacattagagtgccctttcaccatttgcacggccttggtttcatcgaaatgcgaacttgtcaaatgcagagctgcattaccggctgattttaacccttcaaataaatataaactccggttttcggcaatttctctggctaactcactggtccccggctctatgcctccgccgtgtatagctaatatgaggacagaagggtcatgctcccgcgttgaaatggaaaaatcggaaggatcttcattcagctttaattcctcgaaactgccgtaaagatctgaagcggcatcagcccgaaagaacggcagaagcaaaaacggtaaaattaaaattgaaattccttttttggttattgatggcatttgtatgtttatgttacaatacaaatgcttcagcctttgaagcgaacggcagaacagggtgactttggacggtttcttctgctctgcctctttgccggctgctttacggtctactcttctaaccctttttgccataacatcatcctttcttttgtttacacttttgtcacaatattatatacgttggacaaaacctccgttcatcttgaagaataaaaacatcaaaacaacctctatcctttagcctaaaaaagtctttctgttcaaagagacggaaagcttaaatgataaaaatgaaacccgtctccttagttttgtttgatttcccaattcaagaatccccgaaaaaatttgaatgtaactgctgtctccataaaaaaaagactgctgttaagcagtctttttttcgttttatttcgtgcctgttgatcccagtccgccgcggtcattgttcccgagcttgtctacttcgatcagctccacttcaggcattttcttcatgattctgaattggcatatccgctcccccttggaaatgtcggtatcccgaagcgcgaatgcaggaaaaaaccagaagtcattgtcgcctttataagattcatcaatgactcccattgaatttgtctgaatgatcccgaaatgcttatatgtacttgaacgcggaacgacatgggcctcgtatccttccggcagttccatcgcaactccaagcgggataagtttgaattcgccttttttgattgttatatgttcagctgcccgcagatcaatccaatcgccctgttcaattttactgattctcgtttgcgtatcatctgaatatttaattttgatttgtaaagtcatgttcgctgctccttttgcttccctatttcagtcgtattgatgaccaatccgtgccccattataccatttaactgataagaatgctgattttggtgtatatgcagccgaagaggaagcacggcgaagacaatgagaataaacctaaaatgaggacccctcctatcagtttttccctccattttcacatgacagcttcaattacaataatgcaaagctatatgtccgttcctttcaacagagcttttttaaaatttcgcctcggtttcaaaaggaatttcgttctgaataaagaatttgaagaataagcgcttaaagggcgcgcgattcttttctgtcccctgcctcaggcgcttatatcaaaagaaagaggtgtctttagaatggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggattacggagcggtccctgacggccgggacaatacagaagcctttcggaatgcgatcgggaacggccgggtcaaagtaaatgttcccgcaggagaatttttggttcaagggataaaactcccctcatggactactatttccggtgagggacaagggattaccgtgcttaagcttcatgaggacactcccgcatacgaatgggtcattactaacgatgattacgaaaatggaaaccgtaatatttttgtccagaacatgactttagactggaatcctgaccgtcaatgcggagtcaggaaccccggaggacagtgttccagctgtttaacgtttgctaatgtgcaatacggctggattaagaatgttgaaacggttaacgcgggtctgcatggtatagatattacatctccgacttacgatcatttgcctgaaacagaatggacgaaagacggctgccgttatatatggattgataactgtgtggcatacggcgccggagacgacggcattaccacccattacagcgaatatattttcatttccaactgccattccggaaacccccgcggcacagagcatgctgagggcagcgcaaactcgaacggcattgaaattgacgacggctctaaacatgtgtggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgccctctatgacggtgtaaccccgagggcgctggtcatctctgcctataaaaacgttaatgtaaacggattcacagctattggtgatccctcatacgactatggcgggaatccagtcgtggctcttcaataccgcagtcaaaatattacgatcaacggcattaaaatacgcggctttacacaagccggggttgacatcaatatatccggcggatctaataaaaccgattatgttaaaattttaaattttgatatatacaagtcttctcctaaaggcatcacaatcggcggaggccaatataacgtaaatattatgaacggtacgatgatcggagacggcggttccgtcggaattacgtcccctaacagtcaggctgtcattctcggggtgcaagcggaaggttacagcgctgccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttccgaaggttcaagggcatttatcgccgcttcaaacaatgtccatattacgggcggcaaagtctccagaacgattctgtcatcagaaagcattacattggaagaaccatacacggttgccggagggcatcagtccatcaaatggaaactggattcagcgggcggccacggtacgttcgccggagctgtcacctcttccctgtcagggtacggagaatattttgaaagtgtaaccggccagaagattcccgccgggacgatcgtcacagtgaaaggcgaaaaaattgaaccggctcacgtcggtgattatatgctcggcgtcatttcagaaacagccgcttttatctcaggagccgcaagcttcggatggcaaagccgctttttgacaaatgagttcggcggtttcatatacgaaaatgtgactgacgaagaaacaggagaaacagtacgcgtaccgaaacaaaacccggactgcagtccggctcttgaagctgactatgaagcacgcgcggccagagacgaatggcatattgtcggactcaacggccggcattacgtacgagtcgacagtacggtcagcccgggagattatatcacggctcataacggaatcgggactaaagccgcggaaggctggaaggtattgaaactgacggccttatacagcgctgaaaaagggtacggcattgcaattgcggttatcaaataggatctcaatatcaggatcatcttctctcttttctatcgggcgggtataatcctgttttttataccgaatgagatgcctctttttcagcataccgtttcatttgtccaagccatccatgctttctgtcatagaatactaccgtcagatgaaaaaaggaggaatatgagtatgagtatggacatgggtatggacatgggtatggatatgaacggacattatgatcaccagccaaagcagcctaaacaaaagaagaaaaagaagaaacaagataaaaagcatcttgattatgattacatcgttgtttataaaagaaaatgcaaaaaatgctgctgacttgacatatcaatactttttacacccggtaaatcccgggtgtttttcttattatgacgtttctccgggctattttcacccaaaatccggtcatcctatcacaatacataaaaagactctattattttcttcccttttcgcctgattaaaagtatttcatttacagaaaacaacataaatagaatgacatgacttttgagaaaatctgctctttgcttggtcaatttttctgcgataccatgaatttgcaacaattttaaaaaatttcctcaggaggtcatagacatgaaaatcgccagaacaatagtcggatcatgcttagctttatctctaacaattcctttcacagccagtgcctcagcagccagtcagtctgaacacccgaatgcgcctcacgtttcacccgttgcaaatccgttagaaagtaaattatcccaaacagcaggccaaaacgtaaaagcagcaggtgttgatgccgggctgaacgtaaacgtagatgttctcggaatcgcagatcgcatagctgaagcagttaagtcagatcaaaaccgaaccggctgggtaaaaaatgtcatggaaacaacattttacgcatcaggacagaagtacaacgtcatggtgttcaatttaaatcaagaatatgaagaccgctttaacggcgttcaattttacggatcagccgtttatgacggcattacttacggaatctgggtcttcgaagacggttcctttaataacaaaggagacgggggctggatcaattgggcattcagaggatggttcgatcgtgataatcagcatattgaattccacagaccttaattcagagaaaacttgcggcagcgcccgcaagtttttattttgataacgggatactgtacatttttcaccgttataacgactatacttgaagtgcgggctccgatcgcagccccggtaaagtctttcaaagtgagggtatgccatgtcaaagtctttaaaaatagtgttgtggagcatattggttttcattatcttgttagtgatgatcggaatcgtttcttacaatcaaactccgtctgcagaaagcgcagcaaaaagaatgctttacagcgtctaatcaattttaagccttcatcggctttttttatttaccgcagaacacttgaagttcttctgttagatcgttacgttcccattcggaatggagtatacgcgtatatcaccaggcagtccgttttgatacatggttccgattatgcctttcgcatcttttttctctattcctcatcacatccacttttttcatgctgctgctcttgaaaccaaccaatcatttcttcagcctgttccgttgaatcaaaaggttccaatcctaatagcgtgttacattttcatttttaaaaaaacaagccaactgcgcaccctcttcgcaacttctcaatgtatgagcctatccgtttctattacaggaagcagtacgattcctccttttactcattttaacggatggccatgtaaaggaaatatagactaagaaaccttttttcaaaaagtaaactagcatccctatcaaacttttcatttcggcatagtatgtattaatcctctttaggaggtgagattatatgggattctcaggtggttatggtagctcctttgcgttaatcgtggtgctattcattttattaatcatcgttggggcttctttcctcggcggttattaagaatcctcttacctccgcatccatgtcagcagcacctccatgatcgtacggcgccataaatgaaatgtttatggcgctctgctgtttttacccttttcattcacacattaaaactaaaaagatcggccgatgaacatgcagccgatcagtaattcatagattattgtgtaaggtttacatcgatgacgttatagaaggcattggaagtatccgcaacgtcccatacccccaaaatgacatgatacccgcttcgatcagtcggcacaaaaatcttatgagtcagattcgtatctgccttggaaccgtcgtggtttaccgttccgattaattcaaattcatctcttgacaaaggtttattcggattccagtttttcttggtgatataatagtgccactttgatgtcgcatgaggagctgtgtagtaccaagtaaaggtgttaaaaccgccgcggatgttttgttttacccaataatctgcagtctgcttgtctaaaccgaagtcaatttgtcccgatcccccatttgcagacgcaattcttccatccggcggacctgcagccggaaatcctttcggcccttctacagactgaggattatcaatgacggagccatatttctgcgcagcggccgtccagcccaatgtttgtttctctaaagctcccatgtacgctctgctgacgggctcttttatatacccgtgcgcagatgcatcacttgaatagaaagcgcctccaatcccaagagtaacagttaaaactgcagctttgaccaaacccttcattactgcatcatcctcccttttttgttaataaaatccctttcggtatatacacttcacgatagaggatgaaatgaccttccttttcttgataggaaaaagcaatgaggttcgcgctttcccctttgttttttataatcataaagaaaaagccgggccgattctgttgtcgaatccgcgattgccaaaaaccggcccgccccttatgctcagaacttcattcgctggatttgcgggtttcttttcggataaccggtgctacttccgctgctaatcgttcgatgttttccgcggcttttttaaacggcatacctcctatatcgatttgcgcgagaaatcgctgatgcccgaacaactcatattgatgcatgattttttcaatgatctgctgtgaacttcccacaaataaagctgtttcttttccggacgcccgctcaaaatctttcttcgttaaaggctcatcgatcccgtgatatgaatgaacgtgagaccagtaatttgaatgatacgggtaaaattcttgtattgcctgttcattcgtttttgaaatgaacatatgtccggtcacggcaaccttcacattttccggaggatgaccggctttagaagccgcttcccggtatttgtcaacaagcggcttagatgacatcggatcaccgctcagtacagccaatgccaaacccgcacctgcacgcccggctcgttctgcgctttccggagtccccgaaacacctaaccatagcggaatgcttccgcaaaaaggccgaggagaaatttctgcctcgcgcagcggcggccggtaacgtcctttccaggtaaccgattcttccccggaatttaattttaaaaaaaggtcaatgtgttcttcaaacagttctttataatggcctacgtcataaccgaaaagaggaaacgagtctaaaaatgcgccccgtcccgcaatgatttccgcccggccgtctgaaatcagatcaagcgttgcaaaatcctcaaataaacggacgggatctgcggtggataatacagtcgtggcactggtcagcttaatattttcagtaatctgtgaaatcgctgataagatggccggcggcgaagataccgcataatcaagacgatgatgctcgcctaccccgaatacatcaagccctgcgtcgtcagccagtttcgccagcttcatcaattcatctatccgctgctttgcgctgactgttttccctgtcagaggatcgggatataattctgcaaatgaataaattccaatttccatacaatcacggtgttcagccctcacatttctctcctcctgcactgtgtaaaaaagcttttatgttattctattcagccgttttataaataggaatttattcaaaataaatacagaagcttaacatgcagaaggccggtatgagaggaaaaaaagtttccggcgcccttcaattctgcccattatactcatgcagccggactaggcaagaacaaagccggcacaagcggattcgaattcatgtgttcgttttcagtccaattcaatccaatcgtgatattgatcataaagctttcctattcttccggcatcaagagcgatgacttcacaccctctgtcatcatatagaaagaaaataatatcttttgtcatattcacaaagaaaacatcgggatacccaacggaacagccccgaaccttggcttcagcggaaaatcttcgtggacggctgccttaagtaattggggaatacgcagatctttccgtttacataataaagaaaactgctgcatttcatattcttctgcatcatcttcttcaaacggacaggggcaggtcttcacctggatccgatataaatcatccttacacttcagaaacggctgataaacctttaattttctcggatgattaccttgagttttgtgcttatatacgttggcaacaaggaacatgtcatcgctatgttcaaacagttcattgaaaagtgcggcggtttgatgatgaacaagctgaaaatactcaagattcaaagcaccgctttcattaaattgatacatattgccgccgagagaaaaatgaagtcccacgtcccattgatgataaatgccgggcactaattttaaagtcggaaacctttccttcagataatcatttattttcattcaaacatctcactttccgtttcccgctccagagacagaagaagccgaaaacattccgcttatttctttttcacccttgtaatattattccgattggaatacaatgaaatagaacactgtgaaccccattgatcagggtggatgctggtcacattcatcctggtcctttcttttacacaagatcgcaccaactttgatcccctccgtttccaaccttatacatatatttcaatggtattattttcttatacataagcatcaagaggtgtcagctttgaacaacatcagaagatgaagagcatatttccggtctcaccgcaaaatgggtcttgactctgaactgcttttcacattttgattatcaagcgcttctttaaattcatcaaaatgaattgaacattgctgattcaaattacttcctgcaccttctgtcgctaaactgcaaaatgtccgtcacaatcatcctctctctaattttacaacattgctataatgattttcatgtttttcccaaccttcaagctgaatctttttgatcgttactaggtaacctaaatacaaaaaaacctgctttcagcagggttttttcggtaaaggggagattatttccccacaaattctattacctatgtttttgttttaaccattctttctttagcaatgcgtattggtaagtgttttcatatttaggtgttccatcctcgtgggcagtaaatgaaataaattcaagaaaataaccttctttacgcattcctaatctctcacatagtttttgtgacctgcagttatcatcttcaacatatgcataaagccttcttgcttctttttgcataaagagatactcaaagaaagccttcgcactttcacttgcgtatcccgccccttcaaaacgggcattgaaattccaacaaacggaataggtatctggctcttcttttaaataaaatagttctccgactagatcattactgtcttttaaacaaactgcaatataagagtcatctcggcttcttttttgaacatttacggcagcttcttctaacgtagatattctgtcatcaagaaaacaattcactctcggatgtgccgaatattccaacagaccttgtgcatctctctcggtaaaatttcttaaaattaagcgatgggtttcaattttttgcatttgcagtctcctgtttcattgttatcgacctttgaaaagaacttcttcgtttgttgaagaacttatcacaatctatttttactataatgatgggtgttatcatctttgtcaaaaacaataatcattcatttgccgcccgcaatgtaaagtactgaacaattttcgtgaaaaaccctcagtatcgaatataaaaacgagcaatagtaataaaacaaagttaagccattaaaagcttattgagtattttttcaaacttatttacgctcatcatctcatgagtgagaaatgtccccttataaaacatgctgaaagtcgtccaaactgccggggatttttgcgccatatcttttgacgttattctcagggcctgaaaatgaagtcctttcttttcagtcagttcctttaaatgctttaacactccgactgcaaatgggcattgagctgtataaaatattgtgattccctcatcattaacggaattacttttcacctgttttttaaatacaggaggatgtgcatgttcattccacgtcagtgacatcaactgaaaatagggttctgcttcatcttgcacagcaaatcccatatgctcgaagaaatgcttatcacttaaataagggagttttttcttccccactatatgaactatcccatccataccgcgggattttgcatctgacacacatttttctaacaagtgttttgcatgtccgttattcttatatttacctgagacccaaaggcaattaataaacataaaattaggtgcgcttaccgggacccacgcttcttctgcaggtaaatattcaataaaaactttggcccgttcgtttaggcggtagaacaccaagccatcactcatccgatctttgagccagctcttcttttcatttaccgcatcctcatattgtttcgtacctaacgcacagcaaatatgattgtcatcaatattgtccctggtcaactcaatgtattccatttttcctcacccgctttcttttggaaacatcagctttacttccgatgaacattgtaatttctcagaaatatagagtcccagtaccaatatatgaacgcagcagcaatgctcattatgtaataaatgaaacttctgaaaaccgtgaaatcaattgacggattacctatgtgccagaacaagaacacagctaaaaaagcgactgcggtataaatgaaaagatgaaccaaactaaactttttaggcttctttcttagccatagttgcacaggaacagcaaacaaaaagtaagtaatgaatgcgtaaaaagcaatgataactacagtaaccaatgcaattggcacaaaacccgagtatacaaacatatatagcccgaaaatcaaaccatacgacaaacttgaaaaagccaatgtgtaggtatagctctttaatcttgttgaattcagcttcaagtcaccgccccgttcatttacttcgcacttacaatatcgtagttttattgtctatttgtctgttttaatcactatttgacattcaattttataatctgtttctcctgtttcaatctttgtatcatcgcggttaactttatatttccctccatacaaacttgctgatatcgggtgccttataccactctttaactgatcgtaaatgtatttcttgccttcttgaaaattctttcgaggaacatgtcctactttgcaatcatttacatagacagctatagcttccggatcgtacttgttgttctcttctaaccgcaattcacaatttgagaaaaggaaattatgataaataaatatcggctcatcaaaagttgattctagaatctctttatttgtcataccatcatatttttcatcgaagaaaaagctgtcttcatcctcagtcttgatggctttcttaatatctttttgatagtgtgatgttcctgcaaccttaaagtctatatactcgaaaaatgcagacttttcttcatatttccttgagaagcctgtctcttgaatcaagattgggaaattttcttttttcgataccatctctgtttcgttattaacgccaacagtgttcatattattatttttattctcattttgttcatttttaactttgttcttgaaaaagttgagtatacccaaatgtacccctccatttgaaataaaagattggtttaatcaaaaaactcatcatcaataaaatcattttctcttgcaagtttattcgaatcctttttaaaaaacctttgcttcaatttttctttaactgttaatttttgtttttgtcctggcatatatgacatatataatctccgttgtttgataaatgaataagtaatttatcgacacctgaccttttgcagatacacatcctgtgctgaccatcactaaacgaaatatgaccgcaagcatttacgcttgcatatattcctgaatgttttttatgcatgtccggttttatgtagtgcgcagccaatcttctgcattttaatgcatattcatgctcttcgccttctaaagcattaaattccttatcagttaaatctaaggagcactttcctgttctaactttataacagtcatgtttacttagcctaaaataaaaagaatgtttcgtaggatttattaactgatccaacctgatccccttctctttaaaagaatgattttatgcaactccttaaaatttgtatttcgttacttttattgtaactttagtatactatgattacttttaattatcagtatacccataaaaaaggtcaaggaaataccttgactgtgtatcgctcaccaatctgcatccggctcatcgtgttcaaatccgtgaaatccacacatctccgcagccggctccttttgtgaccaataagtaatgatttctgtttgcatcaccattcaccttatcagccgcgctcaagttcaaatgatcacccgtgaaattcttttcactaagggtaaaatcatatcctgacggcgtaattctctgcagtgcaagtcaaatatctatagaaagattatgaccgcaaattcaaagcattctgtgcatttggagatgacaaacccccatttaaacacccttcggatgacaaatcatccgtagaatcctccctgcatagctccctcaatttttgtagagacacttgtccgcaaaaatgtaagggttttcaaaagaagagtcgtgtgctaaattgtaagataagtaaaaattttctgcgaatatttgaaaggggtgtatgatttgaaagcagtagtagcaacaaaagacaaaagtatagcgatcgtacaaaaagaattacgtcctttgcggcatggtgaagccaaagttaagatggaatactgcggtgtatgtcatactgacttgcatgttaaaaatgctgatttcggggatgttaccggcgtcactttaggtcatgagggaataggcattgtgactgagattggtgaaggcgtaacaagcctgaaaaagggcgaccgcgtctctattgcctggatgtttgaaagctgcggccgctgcgaatattgcttaacaggccgtgaaaccttgtgccgtgatgtaaaaaatgccggctatacagttgacggcgcaatggctgaagaagcaatcgtagcggtcgattacgcaataaaggtgccggaaaatttggatcctgcagcagcaagcagcattacttgtgcaggtgtaacaacttataaagcggttaaagtcagtgaaattaaaccaggtcaatggatcggtgtatttggagtcggcggtttaggcaacttggctgttcaatatgcaaaaaacgtctttaacgctaaagtgattgctttcgacattagcgatgaaaaattgaattttgctaagagcttaggcgctgatgcggttgtaaacagtttaaacgaagaccccgtcgctaaggcaaaagaagtgactaacgatttagggcttgatgctgtggtcatcacggctgtctctaaaacccctttcaatcaagcgattgatgttgtaaaagcaggagcccgtgtagtcgcagtcggtttaccggtggacaaaatggatttagatattccacgtcttgtgttagatggaattcaggtagtaggttcattagtaggtaccagagaagacctgaaggaagcttttcaatttgctgcggacggtaaagttgtacctaaagtgacaaaacgcccgatcgaagatgtgaatgatatttttgaagaaatggagcaaggtaaagtgaccggccgcatggttatcgattttacttcctaatcattaaggctgccgggaatgatacggcagcctttaatctctattcttgctcagcgccccacccagactgaataagactttgtcatttagttcagaaaagaaactttacagaccattcggcggacatacattttgcaagtactgcctggactaaccctgataccaatataattccaggtcattcattgccgaagcgtagctgttatgaggaaacccaccagaggttcctcataacactaaaaacctactcactgcactttttacagcagaccttatcagagtgtttgcttaacactttgtccattctacccacaggcatcttcttctcactcggaagtgtaagataagctgttatctcatcccctgattttaatgtttttccgcagatagagcattttaactcagtattaaagaaattttttaatcccattcagaagcctccttatttacctttataaagtaatacgttaatgctttataaaagtttcaggttaaagaaatactccttgtccgggaatttactttctttcagttgttacgtacccgcacagggttaacaatcgtcttgttctttaactcacagtgagaagatcgccttgtaaaacattagcgtaaaatcatcttcatgctttgaccagtttactgcagtgcatggattgttaatttgtgacacttatttgtcctctttaaatttttcttcttctctcaacttgaaaaagaaggaattattttataaatattgtaaatttatagctgtatcacattcactattaagaggaggaatacgaatgaaaaagaaaattattgccggcgctcttgcttttgggttaattccgctaatgggggctgcagatgtttctgcaaaatctttgccaaatcaagataaagtcatgaaacctgccggttggtcatgtgacgctccgtatattgcgtgtcagcctttttctggcggtaccggtaagatttcattcaactatcaaggcagctctccaggaaaaatcagagtttttgtagcgaatgacggcagcaaatctttcaaattcaccattaattatcctaatgggaatacactcttatcctctacgacactaaatgcggggaaaacgttcattcaagaattcagcgttaaccaaaaaggagaatacatcctgaaatatgatagcggcaccggtgatagtgtcgatggtttctttagatctgttgagatctaaattccgttaggaaagtcggcagttttgccgactttcttttccaagcattctgcaggaataaacgtaaagtgtcgaataaacatatgacctttttgaaacggaaactttatctgcaccacaaacccgcaagcagcctccttgtatcgtaccttccgtccctttgtgatttgttttgatttgtcgtatactgcgcttgcccgggaaatgatgaatattttcgttaactataatttccctgtacctcttcgtatgtggctctgcatgatgaagtaacgtcatggctcaccactttcatccacagttttattgcatgttgagccatatccctcctctttaaacagcaaaccgtcccatccatttctctctttccattatttcatattcttagaagctcttcattttagacttaatatccattttttcttatttagacttaaatctatgtcgaaatttatcgtccggcatattatgtactatcctaacaacaggaggtggcaataatatggggaactacggtggaaattacggtggaagttctttcgtattgatcgttgtgctgttcattttgttaatcattgtaggtgctgcattccttttctagcacattgacgatttatattcgtctcccaaacattgcatcccttagttcggacagacgccataagaagttttatggcgtttttactttttaaaaaaatctatctaagataaacattttttattttcactctggtaagcgggagagttttctcccctgcctgcgccaatattgccgctatgaagaataaggtgaacaattcaattcggaataaagacttgttcatgaacaaaacccctaaatagttgttaaaaaactaaggcgtttttaattcatcaggattacagaggttgtgaacttaaaaaggatattactcacctttataaaattgtcatcgttagatttagtcactgaatcttttttgtaagggtccgcccacaaaatgcggtgttcacacattaaatcattttcacataaaaaaaccggattcctcttctaaaaggttccggcttttctttttgttcggtatttgtcagttaatatgcaggaaatatctggtgacgtgcacacacccgctattataatatttcaatagagccttctgttccatgaacgcggattcgctgcccatcttttatcaattgggttgcattttcaactccaacaactgcaggtaagccgtattcacgcgcgataaccgctccatgggtcatcagtccgccaacttcagtgaccaggccttttatggacacaaacaatggtgtccagctgggatcagtataggggtaactaatatatccccatcttccaaatcggcatcttccatgtttaaaataacccgtgccctgccctctatgactcccgaggaaacgggcagcccggcaatcgctccggccgggagattttctcgtttgtactcgcctgtaacgatttcaccgtcagacgtgataacacgcggcggagatagtttttcatatactttgtactcgccttttcgtgtgctgatgatttggtaatccaatttatttgtgcgtacgacttcctgaagttcttcaaaagtgagatagtatatgtcttctttttcatgaataacccccgcttttgcgagttgttcggcttctttcagtaaagcctgcttataaacgaagtagcggctgatcatgccgtattttggatattctctgaatccgctgaagttccggatgatttggatcattcgtttagtttctctggctttttgttcaccgtccggtaattgcttcaatcggtctaataactcttgttctttcttcaacgcctcctgccgcccttgctcaaatttccgctggctggcatttggctcaaagtttttgagattattaagaatcatagggacaagtgcaattggtttttcgctccatcgagttcttgtgatatcaatttctccggcacatcgcattccgtacttgttgagataagcatagatagcgtcatgggtttcccgcccgccttcaaacttcaccagcccatccaaaaagtgatcatcttttacattctctaaataggcaattacttctggataaggacggatcacatcggcgacgtccaatagcgcaagccccatttctgaagtaatattatgaggtacagattgagaaagcgtatctgctgcgtttttttcacctaaccactcgttcattttttcgttaatccatgatgaagcatccattgcagttcgaatcagcaccgaactttttggattaaataaaatattctttaattcctggatatcttccaaaataaaacgaaataaatcagatcctgatttcgtctggatgttttgttttaactcttctatcgatgcctgactgctcttaatcaaatcagaaacaattgcaggatcgttttcagcttgatccggcatatctgcattgcctttgccgggaatcggcgccgttttatcatgtatcggtttaatgaaatcatctcgctctattatggtcataagtgcgtcttttaagagcggatcgtgctgccccataccttttaagaaaacttctctgacattaggggatgccagttgatgtgtgacatcgacaaatagccttccgccggctttacgcatgggtgcagcagtcgtcaacagaaaaaaagacaatccaaggggttttatgggatccgtcatcatttgctgatgaccgacagagatatagacgtgattttcttgatcgttcgcttcaggaacggggtataacgttgtgatcggacgactttggacaatataaaaagtatcgcggtccaaacaccattcgatatcttgcggctggccgaaatgagcttcgatctgtctcccgatacgtgccagctgtaaaatttgttcatcagtcagtgtttgaatcttttgctgatcaagatcgatctcccgtgtttccgttccgccttctcttcgttcatagacagccttttttttggtttctattctcttatcgacgatttgcccgtcctgtactttataacaatcggcagatactaagccggagaccagtgcttcaccaagtccaaaaccggcatcgatggacagcagctttcggtttccggtcatcggatcagcggtaaataaaatccccgaagcctgggggaacaccatcctttggatgataacagataaataaacttggctgtgatcaaacccattttgcatacggtaaatgaccgcgcgatccgtaaatagggacgcccaacatttactgatatgctgcaagatcgcatcgacgccggtaatatttaaataggtgtcttgttgaccggcaaaagaggcatgcggtaaatcctcagctgtcgcactagaacgtacggcataggcatgttcttcgccgaaccgggagagatggcaagcgactgctttgactacatctgaaggaatttctgcttccataatggtttgccggatttttttgctgacttcaccaatttgatcccgattctccgctttcagcatggtcagttgacccaacagcgcttgtaacgtttcgttttgttcaatggcttttcgatatccggcggttgtgacacaaaatccttccggtacttgtattccttgaatttttgataattcccctaaatgtaacccttttcctccaacgagcaaaggctgtgttttttcaatttcgtgaatgccgagaaccaaagaactcattctatatctccccttcaaaaaaatttgacaagagcttttcagcatgatataatcataatataagatggataactatgacttttaacacagaaagcgcgcgtgttctgattatatcaccgtgtctgtttttgtgcaatataaaaagaacctggccaatttggcgaggttctttcttcattttctaaggaaatcctgaagttgagtgatacctgtgaatccattgcagaaaggctatccccacggattcaagaaacaggaaaatctcaataataaaaaacatcccccacgcaatgtgaggggatgttttgtgtgtatacttctcatttcatcgtcatatgagtttagactgatgcagtcacaacttacaagaatgcttatctgtttccttcaatagtgttaacacatttgaagttatattagcgctgccgctgctttgatatccctaaactgtaatcgcttagtgtattgcgcgggagaaagaattgcattccatggtttattaatgccggctttctcatttgttaacagatttataaaaccaaggccattgataatgagtggccgtttattgttcttcctttgacctcctgaaaattaggtttgtctaaagctctttaaagctgtattgatatcttttgtgtgaacgtaaatgttcttatacaactcgaatagtgttttatatttttgaacattttgttcttttggataaaatgcagctgcttcatgaatgaactgctctgcacattcttcaagagagtcaaaccacccgcttccgaaggcagctaacatcgcagcccccatggccggaccttgttcattttctaacttaaccaccctcgtattgaaaatatcagcctgcatttgaagccacgtttcatttttagctcccccgccaatagagacaaccgtatcaactgattttcccgcttcgcggaatagctcaattgattcatataaagagaatgtgatgccttccattatcgccctcaaaaagtgctctcttttatgggctccgtccattccgatcaagcttccccgaatagatgaatcagcatgcggcgttctttcaccgactaagtaaggagtgtacagcagtccatttgctcctatcggaacagattccaccccccgcaataattgttcaaacgattcgttcggcgcaaacgttcttttaaaccagtccaagctgtaccctgcagcgagcgtgacccccatcgtataaaaagaatccttttttccatgattaaaaaagtgcactttccctttaaaatccctttctttgtcttcttcacaggaaagtatgactcctgacgtcccaatgctgcataacgtttttccggaagaaagaataccggctccgacagcaccgcaagcattatctgctcccccagcgtacacttttgttttttcgagcagccctgtcttcgccgcaacgctcggaagcagcgatcctacacagtcatgggattccacaagcggaggacaaatttctgctgaaataccaaattgattgcaaatctcatcgctccactctttgcgggtcatatgtaaaagtaacgttcccgccgcatcggagtattcggtgtgaatggcgccagtcatgcggaatctcacatagtctttcggaagcagaaaaacagcggttttgttaaaaagttcaggctcatgttccttcacccataacattttaggtaatgtaaacccttcaaggacacgatttttgtgatatcaagcagatgattgccaaatgtctcggttatcctgctgcattgaggcgtcgttctggtatcattccaaagaatcgcatgacgcagcacccgccgatcttggtcaagcagtactaatccatgcatttgtcctgaatagctaatcccgtcaatatccccggcttgaacgttggatatcgaaatcaattcagccaacgcttcaattgtttgctgcacccagtcttcaggattttgctcactatatcccgccttctcttggatgagcgggtaacttttggacgtttctgcacaaaccttgccgttttgattgactaaaatggttttaacagcactcgttccaaggtctattccaatgacatacttcattttttcactccttcctctctaaatagatttccgttgaaatgacccgccataacagtaacttcatgacgggcaattccgggaacttggctgcctgcatcttttatgcgggatctggagcttcttttttcatttggttatacctgtaaaatgtattggtttaatatcgcttttagccgttcctgtctccctgattcgtttttaattggctgattgttcagcgcatattgctcaagtgtcttaaaatcagctcttccttctgcaatttcaagaccaatcccttcagtaaagctgcggtaacggtgttgaatcacatcttcaaacacacgatcttcgattaatttgtgggcggctttcaaccctcttgcaaatgtatccatccctgcaacatgggcatatagtaaatcatcaggctcaaaagaagatctcctgacctttgcgtcaaagtttaatcccccgcttccaagaccgccattttgcaggatttcgtacattgctaatgtcgcagaatataaatctgtcggaaattcatctgtgtcccatcctaaaagcggatcaccctgattcgcgtcaacagagccgagaaggccatgcactctcgccatgcgtaattcatgttcgaatgtatgcccggctaatgtggcatgattggcttcgagatttaatttaaaatgattgtctaagccgtattgctttaaaaaggcaatggttgttgctgcgtccgtatcatattgatgggtggtcggctcttttggttttggttcaatcaaaaactgccctgtatacccgatttccttcgcataatccactgccatatgcataaatctggccatattatcaagctcaaattttaaatcggtatttaacaaagtttcgtacccttcacgtccgccccaaaatacatagttctcggcgccaagctcttttgctgtttctaatcctttttttacttgggctgcggcatacgcaaatacatctgcattacaagaagtcgccgcaccatggacgaaacggggattcgtaaacatgtttgcagtattccataataacttaacgccgctggttctcatgtagtcttttatcatgtccacgattatatccagattttgatttgtctcttttaacgtacttccttccggtgcgatatcccggtcatgaaaagcaaaaaatggcgcatccagtttttcaaacagctcaaacgctgcatctaccctcgctctcgccagatccatgcctttatagtgatcccacggtctctgcatcgtagctgcgccaaaaatgtctgtgccgtcagcggtaaatgtatgccaataggcaatagaaaatcgcagatgctctttcatcgtttttccgccaattacttcttgagaattatagtatttaaatgctaaaggattcgtggattctttcccttcgtaaatcactttgtttacgctttcaaaatagttgactgaaccggaatgagagtgagccatgtgtgatttcccccttaaaaataaattctaaacttgatgattcgaatacagatgattttatgtcatgttatatattagtttgttgcctaaacaaactaacttattttcatcttatataacctcatcagtattttcaatattttttttagttttttacgaacacattagatataataaaggttggattcgctatgtactgcgtttcgcacgataacacagaacgttcaacttaatttaaagattatacaaacggagtggatgaagtggatatcgctgatcaagcctttgtcaaaaaagttaaccaaaagttattactaaacgaaatacttaagaattctcctatttcaagagcaaaattatctgaaatgaccggattaaataaatcaactgtttcatcacaggtaaacacattaatgaaagaaaatcttgtatttgaaatcggtcagggacaatcaagcggcggcagaagacctgtcatgcttgtttttaatagaaaagcaggatactccgtaggaatagatgtcggcgtggattatgttaatggcattttaacagatcttgaagggacgatcgtccttgatcaacaccaccatttggaatgcagctctcctgaaataacgaaagatattttaattgagatgattcttcactttattgcaaatatgccgcaatctccgtacgggcttattggtataggcatatgcgttcccgggttaattgataaaaatcaaaaaattgttttcgctccgaactccaactggagagatattgacttaaaatctttcatccaaaagaagttcaatgtgcccgtttttattgaaaatgaggcaaatgccggcgcatatggagaaaaagtatttggtgctgccaaaaatcacgataacatgatttatgcaagtatcggtacagggataggaatcggcgttattataaacaatgatttatacagaggggtaagcggattctctggagaaatgggacatatgacaatagactttaatggtccgaaatgcagctgcggaaaccgaggctgctgggaattgtatgcttccgaaaaggctttattaacatctcttcagacaaaagagaaaaaagtgtccactcaagatatcatagacctcgcccatctgaatgatattggaactttacatgcattacagaattttggattctatttagggataggcctgaccaatattttaaatacatttaatccgcaagccatcattttaagaaacagcatcatcgaatcgcatcctatagttttacattcaattaaaagcgaagtatcgtccagggtttattcccacctagacaatagctatgaattattaccatctatcctaggaaaaaacgcaccggcattgggaatgtcctctattgtgattgatcattttctcgacatggttcataactgaaatgtacaaacttctatgttttacgctcatctttaaagatgggttttttgttttgttattttcatcctgaatgggagcatttctgacgtgtttttccacacgggcattttctaatatgaaaaaggagttccaaaatagaaagctcctttttcatgcggacattcatttttctttataacggaaatatctgaagtcggccggaatatgatttccgctcgtatcttggcattgcatccctacaaaagctcctgtaaagaatcccccgccgcggatgtaatcatctgataatttttttgattccaatgcaatatcgattttgtaccaatcttctttgttaaatgaatagaaataataatatttttcgttttcaatattcacttttaaatagacgtacttgacttcacgaggaatcacaattttattttttaacggttgtgaaaaagagaagttatcacatatcgttaattcaagaatacggccaagttcttcatcatgcgtgacttgaagagccgtccagttctctgtattgtaatagttcaccaaaccagcggcttgctgaaaattttccggataaaacgcaacagccgtttccgcttcaaaatggagactttgccagcgtctggctacaaatgcctgagtaaatgtcgaagttaaggattcatggccgtataatcgtaaatgatttggcgcttgagttaatgaacctaatttctccgtaaaagggattcttaacgtttgaaaattaatatttaatgtcgcatcctcaaattcatcaacttccggatacgtgtcttcaaatatggtttcaggtatagaagacgcatccacctccaagctcccttcttttccgccttctacataaggccagccatctttccaatagagcttttgaatagctgtttctctgcccaaaggacaatatcctcgctgctgaaaaattgaatcatcgtccgggtgaatgggacgtcccgttaaatgagctaaataccactcgcctgtatgtgtgtgaacaatggatgcatgcccgcatttttgcaatgggtttcctggatcatgccatgacgttaagattggattatcgggatgaacttcatatggccctcgatatttgcagaacgggcaattgtagcagcgtgttcgaaccgcgttcctccttctgcggttaataaataataatagttcccgatatgataaaggtgcggcgcttccgtcagctttctttcagttcctttaaatatcactttcggtttaccgatcagtttttgctccttatcagaatattcctgcatgacaatgcctccaaaggagtgccgatcaatacgctgatcccataacatatttaataaatatttttttccatccgtatcatggaacaaagaagcatcaaaccccgagctgtttaatgtgatcggctccccccaatcaccatcaatcgtgtcacaagtcactaaataattgtggcaatctttccaagcgccatctacgaccttaacatccgtatagatcagccaaaactttccgtcgctgtaacttaaacatggcgcccagaccccgcctgaattaggatttcctttcatgtctaattgcgaaactctctgtaatggatgtgcaactaagtgccaattgactaaatcttttgaatggtgtatctggactcccggaaaccactcaaatgtagatacagcgatataataatcctctcccactctgcaaatactcggatcggggttgaatcctttaagtactggattgataatcttcatgcagaacgcctcctcagctattttctgttgactatcatgttttaagctttgaaatcgtcaatatgatccaaataaactttgtctctattctctaattctcgaaccatgtttttatattttttctcatctaagttatagaaattaatatcaatcatggccagaaccagtaagaacacgggaataatggttgctgtaattaaaattcccgtcaatgcctccggcgtttgcgcctgatttgccacatatccaaactgatctagaaccaaacccggtacaacccctcccaaggccatgccgaatttaaagaaaaatccgataatagcgtatatgagaccgcccattcttttcccggtcttatactctccatattcgattgtttcaggaataagcgcccacatatatcccccggcagtgagacttcctgcagcggccagcaatcgaaaggaaagtatcaggaatacattacttggcggaacaaacagtaaagctaagaggccgatcatattcagtaataatgcatagtttagtaatttcttcttccctaataattgatgaagctttggaataaacggtaaaatgaccaaagcaggcaaacttcccaacaaaccgtaccacttcactaaatccgctctttctaaattatacgttacgtaatagatgccaaccgaattactgattgaattcactccaaaaataataataaaaaaatacttagtacaactagaggccgattaacacgaaattgctcaaatatatccgataatttaattttttcttcagatttttgaagcgtgacacgctcttttgtgcttttaaaacaaaagattaaaaggcacccgcctataactcccataatacccatggttagctgccagccaagagattcgctgccggacgtatcgcttaaataagcagccagtaagggaacaaaaaatgcaacgacaagtccccaagattcgcaaataacatacggacagacgttatactaacaacttcttgattatttcgggtcattgcagaggttaacgcgccatatggcacgtttatcattgtgtatgtaagcgataaaccgacataggtgatataggcatatattaatttcccaatatccgaaaaatccggggttgtaaaacagagtattgccagtatgacaaatggaaaagctccgaataaaagatacggtctgaagcgtccaaacctgctatttgttctgtctactatcgttccaataaaaggatcagcgagagcgtcgatgattctaaccactaaaaacatcgtaccggctgttgctgccggtaaaccaaatatatctgtatagaagaacaaaagataagtagacactgttgcataaattaaattacatgcaaaatctccagacgcatatccaactttttcaaccatgctgatcttctttacattttcactgagcatgatttcctccccttttcgatcctttacataaggaacatgatgaatggtataacatttcttcaattttatcggccagtgaggtctttataaaagcgctttcaaaaaatgatagcagtttactttcacagagcactttcatcgtagtgaacaggataaaagcttggctttcgttttatatatacctccaattaaatcgagcctcttatccccttccatttaagacctttacatgaaggacaattaaagcggtttattagtttgttgatcgaacaaactaacttgatttcatattataaaatcttttctgctttttcaactcttttttcagaaaatttaaaaccgatcaaaggacataccatgttgtaattgccggctccttcgacagacgttaagtaaaaaccctatgtgtcacctgactgatttattaaatgataagcacttccatcatcttttgtttagaaaaacttattaagaaacatgcacttgaaaaaatgcgaatcatatataagtgatatcccgtttaattggttgaggaggatattatgaaacctatgctgccttttgaaaaatattttggtgatttagaactggtttatgcattttatggagctatgcctaccggtgttactgtctcagaaaccggtcgtatattcatttgttttccgaaatggggagacgatgttaaatttacggcagcggaaataattggagataaattgcagccttatcctgattcacaaaccaatttggttaactttgagaatatcaaaatgactttcatcagtgtccaaagtgtagttgctgatggaagaggaacgctttggatactagatacagcggcgcccaatttttctgaaccaattaaaggcggggcaaaattagtcgctgttgatttaaaaaccaatacaatcagaagagtgtatacctttacagaagatgttgtccttccaacaacctacctgaatgatgtccgatttgattttcgtgtcggaactgcaggttatgcctatataacggattcttcttccaaaggaccaggagctattatcgtcgttgatttagaaaccggaaacgcatttagacggttaaatggagcaaatccaacttcaccggattcctcttttataccgaaagtagaaggcaaaattttgatgaatcgtaacaaggatggttcaacttccccatttaggctggcatccgacggtattgcgatctctcccgacggaaaggtattatttttttgtcccctgaccagccgccatttgttctctatctcaacagaagccctgagagatagaaatatatcggacatggatttactttatcatgtggcgtattggggagaaaaaggcgcgtctgatggaatgattacagatgcaaaaggagccgtttatgccggagattacgagaacaatagtattcgaaagatgctgccgaatggcacaatggaaaccatcgcacatgatccgagaattttatggccggatactttttcgattggtccggatggatacttatacgtcatcgtgaaccaattacatcggcaggctagttttcattatggagaagacttacgacagaaaccttatagtttacttcgtatcaaaattgatgaatttcctgctcctgctttttgaaaataaaaatggccggttcaattttagagcataattggcttcatttagcctccatcctaaaccgaataagggattacaataaatacgtgtcctcaattatggagttagattcataacttcattttttttggtcaaggaccaaaatatcgacctcttaaccttttgaccaaaacttaaaaaatcccctgacaccaatagtgccaagggattgagagattaatactgagacatgtattgttcgcgctcccacggatgaacctgtgtgcggaacatatcccattcgatttcttttgcttcaatgaagtgttcgaacaggtgctcgccgagcgctgcaaccatgacttcgtttgatttgaattcgtcgagagcttccgccagtgtcgccggaagatctacgatgccgttttccatgcgctcttctttgctcatgacgtagatgttgcggtcaatcggagccggtgcttcaagtttgtttttgattccgtcaaggcctgctgcaagcaatacgcttaacgccaggtacgggtttgccgccgggtctacgctgcggacttcaacacgcgtgctgatgccgcgggaagccgggatacggatcagcgggcttctgttttgcgcgctccatgccacgtagcaaggtgcttcatagcccggaacaaggcgtttgtaagagttcactgtcgggtttgtgacagccgtaaagcttgtcgcgtgttttacgataccggcaatgaaatgttttgctgtttcactcagctgaagatcagcgtctttatcaaagaatgcgttaacgttatctttaaagagtgataggttgcagtgcataccggaaccgtttacgccgaacagcggttttggcatgaatgtcgcatgcagaccgtgtttgcgggcgatcgttttgacaaccagtttgaaagtttggatgtcgtcacaagaacggatggcaccggcatatttaaaatcgatttcgtgctgaccaggagcaacttcatggtgagatgcttcgatttcaaagcccatttcttcaagctcaagcacgatatcgcggcggcagttttctcccaagtcagtcggagccaggtcgaagtatccgcctttatcgttcaattcaagcgtcggttcgcctttttcatctaatttaaacaggaagaattcaggctcaggtccaagattgaaatcgctgaaaccgagttctttcatttctttcagaatccgtttgaggttgttacgcgggtcaccttcgaacggcgtgccgtccggattgtaaatgtcacagatgaagcgtgctactttacctttttcagccgtccacgggaagattacaaatgtgttcagatcaggatataagtacatatcagactcttcgatacggacgaaaccttcgatggaagaaccgtcgaacatgcatttattatcaagtgctttttcaagctggctcacaggaatttccacgtttttaatcgttccgagaatgtctgtgaattgaaggcggatatactttacgttttcctcgtttactaattttacgatgtcttctcttgtgtactttgccatttcgtaaaactcctcctctaaaaggtaaatgtatatagcaaaacagttgctaacggattaatgaaagaatcgggacatgtcaccttggcggaaagtatttccccgctggaaacggcctgcctgcatcagttcgtttttcagaagctttctgagttcgtcatcagacagattgtgtttcatcggtttggcggttttttcggatttttcttccggttcggcagatgccttatccagaatttgtttgatccccgccatattgacgccttgttcaatcagatttttgatttctaacagtttatctacatcatggaatgaaaataatcgtctatttccttcgcttctcgctggaaatatcaatccattttcctcataatatcgaatttgccgggcagaaagttctgttaactgcatgacaatcccaattggaaataaaggcattgagcggcgaatgttatcactcatctcaatttcctccttttcttatcttagtctcattataggtgatgttatattttgtgtcaacacaatgtaaggaatcttaacatcaaattctttgaaaattgcaaacgccctaaatcagctctttttccattaaagcatttacggcgctgcaaatcgcatttttcacgtgcgcgtaggttaatcctccttggacatacgcgacataaggcggtctgataggtccatctgctgataattcaatgcttgctccctgtacgaaagtgcccgctgccataatgacatcgtcttcatatcccggcatatagctcggataaggcgtcacatgcgcattaatcggtgatgcatattgtatcgcctggcaaaaagcgatcatcttatcagggtcctgaaactcaactgattgaatcagatccgttctcggcgcattccatgcagggtttgacgtaaagccgagcttttcaagaaaacgggcggtaaataccgctcccttcaagctttgcgccactacatgcggagcgagaaagaaaccttgatacatttcctgcagtgaataaagcgaagcaccggcctcacttccgattcccggggaggtcatccggtaagagcaggcctcaatccacttggctttccctacaagatagccgcccgttttagcaaggccgccgcccgggtttttaatcagggagccggccataagatccgctccgacgtggcagggttcccgctcttctgcaaattctccgtagcaattgtccacaaaaacaatgacatcctctttgatttcctttacgaaacgaatcatctcttcaatttcatttattctgaaagatggacgattcgcatatccttttgaacgctggatgccgatcacttttgtattcggccggattgcagcccggactgcttcaaagtccactctgccttctgatgttaaatcgactgcattgtatccgatttgaaattccttaagcgagcctgaatactccccgcctcttactccgacgatttcctcgagtgtatcgtaaggcttgcctgtgatataaagcaattcgtccccgggtctcagcacgccgaagagcgcgattgaaatcgcatgcgtaccggaaatgatttgcggccgcacaagtccctcctctcctccgaacacatcagcatagatcttctccagtgtatcccgtccgatatcatcataaccgtatccggttgaaggcgtaaaatgcgtatcgcttactttatgttttctgtagctttgcaggactctccattcattccgttcactgatttcttctattcttttatgaacggcggagatttccgcttctgtttcttcggcggttttttgtaaaagagcgccgtgggtcagtgtgtcaaacatgttgtgtataccttccttacatgaatttcttcaattctccgagtatgctttgttcttcctgtacataacctgagacttcgtagcgttcattttcttcattaaaataaaggctgtcgatcatggtctctgatttgatgcgtgacatcaatttgccttcggcggcaggcacatgaacttcatacggtgtcatcagctcccggcgcaaataagcttcgatttccgcttttagtttcgcttcatccccggcgattcgggcgctgatcatgatgtggccttctcccgctgtcgggatgaagtcaggaagtgtctcatcacgtttgttataagcggtcagcaccggaatatcatctgcctcaagctcttttaacagtccgaggacagtctgttcatgcccggcataatcttcattggatgaatcaatgacatgaatgatcaagtctgcttccttcacttcctcaagcgttgaacggaaagcggcaatcagcgtcgtcggcagatcctgaatgaagccgaccgtatcagacaaaaggacgctgtagccgcttgggagcgccatctttctcgtcatcggatcaagtgttgcaaacagcagatcttcttcatagctgtctgagcttgttaattgattgaaccacgttgattttcctgcattggtataaccgacgagtgcagcctgaagcacgccgttctttttgcgtctctcccgataacggcttctgtggcggataaccgttgacagctgcacgttaatttcgtgtatgcggtttctaatgtggcgccggtctgtttcaagctttgtctcaccgggccctctcgtcccgattccgccgccttgtcttgagagattgattccttgtccgctcagacgcggcagcgcgtattgaagctgggccaattcgatctgaagctttccttctctcgtcttcgccctttttgcgaatatatccaaaataagctgcgtgcggtcgatgatcttcgcttcaattgcagtggcgagtgatttaagctggctcggtgacagttcatcattaaaaataaccagatccgcttcaagctcttcacacagcgccttcagctcgtctactttccccttgcctatgtatgtagcggcatccgctctgttccgtttttgcgtaatccgggtcagcaccgttccgtcagccgtttttgtcaatgaagcaagctcttccatggaatgttcaaagtgctcatctgtcatgtgcggaagctggcagccgaccaaaatgaccgtttctttttttccttcctgttcgttcaaatggatgttcctttctgtgtcgtattgggcagtagtactatcataccaaacccgcagggcgtataccacacatccggcgggttttaaagagagaaataaaaaagagacccctcaaaccggctgagaggtctattcgtgagctgccgcctcatcttttataagtaaatcctggctcttgatcgtcattaaatcgtttttcaagtattggtctcccattaaaagtctcatggcctgagcgcggatcgatttttcaatcacgtttctgacaaagcgcccgttgctgaatttaatggggcttgtcgtgcttttcactgtcattaagtaatcttttaacttccactcggcttcctggcttaattgatactcccgctctgctatcatgcgctttgcgatgtccatcagctgagtgacagagtaatccggaaaatcgatgctgatagggaagcgcgattgcagaccgggatttaatgacaggaaatgtgtcatttctctcgagtaccctgccaggatcagaataaattcatgctgtttgtcttccatatgtttgacaagcgtatcaatcgcctctttaccgaaatccttttctccgcctcttgcaagtgagtatgcttcatcaatgaataaaatgcccccaagcgattttttaatcagatctctcgttttttgcgccgtgtgtccgatgtattcaccgacgagatcggcacgttccgcttcgatcagatgtcctttggaaagaacgttcatctcgaagaaaagcttgccgatcagtctcgcgacggtggttttcccggtgccggggttccctttgaacatcatatg
